United States Patent 10,724,096 (METHODS AND COMPOSITIONS FOR INHIBITING AND TREATING NEUROLOGICAL CONDITIONS) - sequence listing, part 27

SEQ ID NO: 279 - DNA, 1745692 bp, Homo sapiens
caagataaggatgataagtgtacatgaagtattacagataaacaggactctctggcctctcctgtgtttatttggtaacgaatagtagataatctctatgatgggaaacgctgaatgacacgtgataatttcattcattcaacaagcaaatattccttaactattaggtgctgaccatacagaaatgacagtgatatgatcccaaatatatattgcttttgttgatttagcgcccaatattttatgttatttgtgagttaaacaccaaaacttagtgaaattacagaacttcttaagtgtaaaataaagcagtgtggttaggcaggattttgtcatataggcactatatgtagaatagtggtttcagtagatttgtcttcctctaaattcactcatgacttgcaatggatggatttttttctttgctgagcctcgtctgacagctgcacacgtttcctctggcttctctcttttaatcaagggtttttttgcaggagccttcattctccacatcacaactgggtgccggggcccagcaggactctggattcggatgatcttggttgaggcaatgtaagacattttcactgtttgcactacagcattcattaaatttttggctgcttggatcagggatgtgacactgtccaactgtagggaaaaaagagaaaaaagagctattattccaggaggttttgttaattattgccaagcgtgggcatggtggcatgtgcccgttgccccagctactcaggaggctgaggagggaggatcacttgagcccaggaggcaaaggttgcagtgagccaagatggcgtcactgcaccgcagcctgggtgacagtgaaaccccatataaaaaaataaataaataataaaaataaaaataactgagcctgatagtctattaatgtcacaataagctgctcaatattgtctatgcccaaacataaatcaataagttctgcctcatttttttgtatctagatggataagtgattatgttcaattaactcttatgctaattatgtaatgtgttttgcaaataaccctaatacgccaatttaaatagaatcctgttaaatattatcctgtataaatcttacttttattatagtgtctcttctgtgctttgtggtattatatggtttcagtttaacaacggtacaaattggaccaattctacaaatgtttacggataaaggacttgctcttaaaaacatatcaatagccatttactacaaaaaggtggagtttagcaacaataaaatacattttctgtttcctcataaaatgttaacatttcgtccatgtaagtagtttgtatagaatacctggatcttttctcaaaaacactaaatacctataaatccttgacaactatgtcaatttggaatgtctgctagcaaacccttgccaaaaccctattgtaattagtgatagctaagaggaatattcaaaaagacatggtacatattccttctcttgcttttggaagtttctcacagagattgtgtcaaaacactagaatgctttctactcgtaggacactagtctaactccctatagtttggattcaagactgttaccagacatacgccttacatgaggattctaagcctacgtgaacctcacttccactggtgtggatctcactttcttgcacctggtctgtcacctgggaaagcagcttcccaatcacagggcagtgtgaactgccatgccaactgcttcttctgagactcctgctgagagaaaaacctgatgctgcttggaaagatatatggtctgtccagtaacctttttggtaaattggtaccaaatgtagcctatgatcttgagtctcaaggtgtacctgaattcaaagacccctgttggatgttggtcctgcacaaaagcaatttttgaaagacaaatgtcaagagtttggttccaagtgtcagaagagcttaaaataattgctaatatctattatatgctgtagtatgcagttgacataaagtaactcatagcaaccctatgaggtaagtactcttattatcttcattttatggatgaagaaacaaaggaactggaaggtctggtgacttgctcaaagtaacacagatattagatagtagggctggaactggaaccaagtaagtctggttctaccttgcgttttttctcattacataaacctgcctccaagaatatcctacttccaatatgtgattatttttcgatatcaaatagttaaataaattatactaaccttaacagagtgtctaaaattttaaagttgactagccagcaactctgcttttaagaagcttgctcttatttttgtaatgcatgttgctaccaggagcaatagagtatcttatttgccaatgcattttgttaggattgtggtttgaaaatttatatactaatttccaagttgtgtttctttggaagagcaaatagaagtactcagtcacccttataggccccaaaccatttaaagacatttagattaagactatttcataacaaaacatttttaaattttaaaacctgggtctcaatacacatatcaataaggcaaagaagaaccataaacaaatcacattataggttctaggacatggaagtacataacatttatctttaaatcttttaaatgtgtcagtataaatacaatcctgattaaccaaacttttttttcttattctccaataaaattaagtcaatttgtttgcttggttttgcaaaaataacaggatttgatcctaggactccagagtttcttctcaatgtagttatttttaaagttgtattcgttcatttacacactactacaaagatactacccgagactgggttatttataaaggaaagaggtttaattgactcacagttctgcatgtctggcagggaggcctcaggaaacttacaatcatggcagaaggggaagcagacacatcttacatggcaacaggagagagacagcaaacaaaagcagggaaaactgccttataaaaccatcgatctcatgagaactcactatcacgagaacagcatgggggaaactgcctccatgatccagtcacctccctccctcaatatgtggggaattacaggtcgctccctcacacttggggattacaattgaagatgagatttgggtggggacacaaagcctaaccatatcaaaagtaatcagttaaactatttggaaatgaagttagcataggcaatgtcaaagggcatatgtatatgtaatggcagattacaactgacagcataaactatttctaaaaagacttaaggatatttgtagtctttttaacttataggtgccatttgcacctcaagattgacctaatggtagtagttttatgccacagtaaatgcttaaatatattttctgtaaccaaaatgcattaacttattcaatgtttttatgatctactctgaatgtctcttttaagagctaattttatcccaatactggcttaatacattcttttgtttctgaacagatttttaaaagaacggttggcattgagagcattctcccttttcagatgcattcaaaaatgctaaacagccagggtggcttcacaggcaaatcagataaggagctttgttaaatccaggcaaagtggtgttgcatctccaaattgaaattgtcaagcttctaattaaattgagaaggtagttcattctttggatatgaagaatcattccaatgggccactgatataattggcacagtagatttgtcctttgtcaatgttccgttagaatgtgacaacaaaagacaacaacttaagttgaaaggggagaaatcaatgcatgaaataactaaaagaaaagtaaatgtaacactacagaaagggccatacataaaaggaaatatgacatttattcagttataatcttgtcctgtcaaaaagcatctataagatgctttttttcctaaagctaatttttttctgaaggagatactctaggccagaaacattttatatcccgtaaaaagaaataatcacaaacaatgccaattcaggtggctactcagaattccttttacttttatttaaaatgacctattataaaaatatacatattggtaataatcctaatatttagctatccttcaaccatgttgacttaaggcaaatgcttagctgaagaaccaattttccaaaatattacagccctaattaaacagattcagaaaaattagtatattctttcccatgtagagccagcaagagtgggttaggtatggcatggttctctcaacaccagtgtttcaaccttagcttcctcttctcagcaccatcaatcaggacactgagatctgccctctccatagcgggctgtataataatattaaaccctgcatcttgattatgcttcaggatctatgagctaagagtaacaaagcaccagcctccatccttgatcctacacttatgtctttcttgaccataagcaaggaacaactaggctgcgtgaaactaaaagaccaaatgacattagttttacaacccatgcagagcttccagaccacagatatttccacgtacctataattttcaactctttcaatctcgatcattctaccattttgataatatttggcaatatttaatatttcttagctcacttctctctctactacagatgtcttgcagaacaaaattatccatttccctaacactgagccaacaggtgactgtctaccatttttagagaatccccttgtattagtttgttctcacgctgctaataaagacatacctgagactgggtaatttataaaggaaagaggtttaattgactcacagtttcacagggctagggaggcctcacaatcatgtcttacatggcaatcaaggcaagaaggaacaaagtcatgtcttacatggtggcaggcaagagagtgtgtgcagaggaactgccctgttataaaaccatcagatcctgtgagacttattcaccatcatgagaacatcatgggaaaaacctgccccatgattcaattacctcccactgggtccctcccatgacacatggggattactacaattcaagatgagttttgggtagggacacaaagccaaaccacaacaccctcactgaacaaattagtttctagataaattaatggtccccaacctgaaactaacagaaaatgcatctgtgtgtttttagctaattcttgtatccattctacccaaacactagtctaaacttccactttcatcaaacctctagcccctcatattcccacttgttctgcagattacttcacttacaacaaatatgaaataagcaaacagacaacaacaataaaatcgaaacagtaaaaatgaaactgtccccaacttctatctttcattcttatccatttctattaaaatgaaaattatctggttctcttcctctctaccttcttgcagactttgcacatttaataacttctttcttctaatatatcttttcttttttttgagaaggggtctcgctctgttgtccagactggagtgcattggtgtgatctcagcttactgcaacttccacctcctgagttcaagcaattctcatgcctcagctccccaagtagctggcattacaggtgcatgccaccatgcctggctaatttttctgtttttagtagagacgggttttcaccatattggctaggtcagtccccaactcctgacctcaggtcatccgccttccttggcctcccaaagtgctgggattacaggcataagtcactgcacttggctcttcttgtaatatatctttattctattcctttctactgactttttcactgtagtatataagtgtttataaaaccatatcttaaaacatagccagacttattaaaaggttatctattatccctaaaactattttcctcacttatcacttcttaagccatctgattcctttcatataaatgcttcccctttatatatatgtatgtatacacataatatataaaatgacacatatatatcaaatatgtgataggatatataatcagacatcttatatattaatatgtaatgtatgctagatgtattatataatatataatagatactaaatatataatagattacatacatgttaaatatataacatatatgtgaaatttttcaattggtaacctgcataactgttttctttcaatcaaatcacatttataagatcaattatttctcattcttgaatgcttaattacatataaatatcacagtttatccattctactattaataggcttttaggtagtttggagctacttaaaatatataaatataaaataaataggaacttatgaatattctagtatgtgtcttttggtgaacaaatgtatacaattttatcaagtatgtacctgagagtgccactgtggaattatgaaaatgcatatattcagttttattggataattccagggatttccaaagtgcttctgcaaatttatatttctagcaacaatatatgagtgttccaatttttttttttttttttgagatggagtttcactcttgttgcccaggctggagtgcaatggttcaattttggctcactgcaacctctgcctcccgggttcaagcgattctcctgcctcagcctaccaagtagctgggattacaggcatgtgccaccacacctggctaattttgtatttttagtagagacagggtttctccatgttggtcaggctcgtcttgaactcccaaccttaggtgatccgcctgccttggcctcccaaagtgctgggattacaggcttgagtcttccaattgtcacacatcttcatctacattttttttcccatatttttcacattaggcatttttgcaagtatgtagagatattatattgaggtttaattggcatctcattaattactaatgaagctcagcatattctcctatggttacagctttgacttgcacatacagacattgttcaattcaatttttaataatccttatatatttttctatagtcttttagattttctatgtatgaaagcatatcatctatgaataaagacagttgtatctttactttttcattttttttaatttttgttctgtattattccactagacagaaatgccagtatacaagtgagcatacaaggtatttttgaatcatactctaactcagggagaatgatttcaatatgttttcactgattttttagttaactcacgtattaaacgagtctttaaaaatttttctagtaaatgaggacttactagtcttccttttactattgatttctaacctaaaatactattgtgattaaagaataagctctgaatgatttaaaacattttatatttgtggatgctttgtttatgacgtataatcaaatatcatatgctttaggtacactagaaaggaatgtgaattctagtattgttacatcagtgttctatttatgacaactggtttccttaagcctattatcagtcaagatccttcccaccccaggtatcaggcatccacagatctgctatagagcaccacagattagatgtatattttctatagttgtatataaatggaattctatggtatgtaattttttgtgtgatgtttcacatggcattacatgtgtaagcttcacgtatgttgctgcatgtaccagtagtttattttatttattgctgagaagtattacattttatacatatactgcaatttgttaattcattatctttgtgactggcatttggtttgtttatttcatttgctataataaataaagttgttatggcattattgtacaactattttgtattgtatgtttttatttctcttgggtaaataactagaagaaaaactatgttctgttgttaagtatgtttctaacttcataagaaattaacaaactgttgaccaaagttattttaccattttgaattccaccagcaatgtatgagcattatagttattctgcatcctcagtcacacttggtattttgatattttgattctttttacattttaggaattttgatgagcataaagagaaatgtcactgttttgttttattcatcttctatggttaataatttttgtcctagcaaaaaatggctactacaatgttaaacagattttcctttatgctttcttccagatatttgaagttagagatttatgtttatgattatgcttactttgtattaatttttgtatatggagtaatgtgcagtacatttttttcatatacagatattgttcaagcatcatttagtcaaaatgattttcttttctttttaaataatcttggaattgctgtcaaaaataaattgatcatttatgtttggctctatttctgcttcatttctatgtctatctttataccagcatcatactatgacgctaacatcactttctcagggaagagttccacaatactaagactagattggatcctcttttttatgttcttatagaaatctatacttcatttaacattagattcatcagaaggcaatatgatccatgtaggtggagacaatgttcttttttacccttttattacttgacacagtctacaggagatatctggcatatgaataagttactggaaatatttcttatataaattgtagaattattaagtgcagaaaccacatgcaaaatactgtcaaaggcagacatgaattcaattattctcttgtattctgcacaaactgttaatattttccagacatttcataccctcactccatctaccaggaggtttctggcctctaaacatggcacaaaaacccttgatcaaataatgtttctcattatttatgtttaaaactcagaatgcaaatctgttggaagtcatgcttgtcagaaagttccaaagtcccaaattcccacttttagattattatttctcttttttttattatactttaaagttttagggtacatgtgcacaacgtgcaggttagttacatatgtatacatgtgctatgttggtgtgctgaacccagcaactcgtcatttaacattaggtatatctccaaatgctatccctcccccctcccctcacccacaacaggccccagtgtgtgatgttccccttcctgtgtccatgtgttctcattgttcaattctctcctatgagtgagaacatgtggtgtttggttttttgtccttgcgatagtttactgagaatgatggtttctagcttcatccatgtccctgcaaaggacatgaactcatcattttttgtgtctgcatagttttccatggtgtatatgtgccacattttcttaatccagtctatcattgttggacatttattaaaaactaacttcttgagaaatatgtcttattggcccaagaataaaacatcagttttatagtcgacaacctgtgtttgagtcccaactctgccacattctaaatacaaagcctggggagaaatcaattagcatatcttgggctcagtttcctttcagcataattacaatacaaatacatttcagtattgtttattaagatttaatgtgataacagctaatcttagatttgtgtatacacatacccatgcacataaatgaagctatagcttttctttctttcttttttttttttttggagacagagtctccctctgtcacctaggctggagtacagtggcgcaatctcggctcactgcaacctccaccttccgggttcacgccattctcctgtctcagcctccctagtagctgggactacaggcacccgccaccacgccctgctaatttttgtatttttagtacagacagggtttcaccatattggtcaggctggtctcaaattcctgaccttgtgatctgcctgccttggcctcccaaagtgttaggatacaggtgtgagccaccgtgcctggccaaagctatagcttttataagtttataaggtgaactggaaaataatattacaccaaatttgaggattttggtggaataaagcttaggacaaattctacccacggttgaaaatccagaaacagcacaagaacatttcttgacaattagaggtgaaggggcaggtactgtgactctttcccattatccacaacacatttgtgtgcacatgcatgtgcacacacctgtacttacacacacataagtatgtacacacacttcacacacttttcaaaatagtgtgaggtcagctcggttaatcacaatccttttggtgagtgtatcagtcagagctcagtaaaaaaaaaaaaaaaaaaaaaaaaaaacagaaactactgtaggtgcttcaaacatggaatttaacacaagaaattaattatataggcaacggaaaaactaagaagccaaatgtaaagcaaccctcacttcaccatcagcccaagttgttaccatcctggtgctgaaggaaatggagaagatgaacccatgccaagtagataaactaacacaaataaatgattgcttgtcagcagtctgtcaattttctcccattggttaactctagctgaaaatcagtaagtagtcaaaacatcttgactaggaaaatgttctgagagtaaaagtaaccatgactagcaaaatggatttttagcctgagcatgcatatcccctcatttttagtatgtcgtgatttcattcttaaaatctcatagtagttaatttttttatttctgtgattataatattgagtatgcttaaaaaataaagttcacacattcatactctcattcaaagaaatgtttgtacaaaatcaacattttgtataaatgtcatcttctctacctccatcactagaaaaaaaatatgatagagggatgggctttagctctcagcccttttacatattcttgatccttaagatgctgtcaaatatgcctattcatctctatacaaattccagtattttgttgggaaaatagaggctgcaagagcaatgggatgcatagattaattgtaaattaatacttatacacataagtatatatactgtacatgtttatataaagaatatggttttctgatttttaaataaaacatcagcttctctatttttttgaaatacagctgaagttttgccacatgttgaaaatttccttcatgacccagatttttcagggtctttgaagattcaaccatggtttaacttgaccctataaactatgtcattggctctattactaaattaatagctgactttcacaattatctataaagtgagagctatactgaaaagatgactagctttagacaattgcaacaacaaaatcaatgataaaggtaccagttttcagggctcttgtgtgcttttgaaatacatatctttctcgtagtctcatttaactggtagatgtgggcactgccatagcgccttgcctgctaggaactacaaacattacaatatgtactatgtcagttgtttaaacataggttaagcagcagcagcattaactcataccattattgcttcatcaacacactggaagtaaagggaagcagataacaagacagtacggtgctttggaaattattccagagatgcctggagcaacaaggttgttatctcagatgtgaggcatagaatatgtcaggtgtaaaaatgcaccctgaggaaaacaattaaagtgactgtcttctatttatttgagactcacacactctgtacctaagtgaatatcagaggttggagaagtgtctgtgatcgggaaatattaaagagttctgttcctgaatttagtctctcttcaaatcagaagtctctctcttcctgcctagagtgtcttataaaacacaaacaatcttccagagtctttctatagatcagcacagctgtctcctagctgagaggacgaggttcaaacacatttcagagcagctggttgttggcttcccagctgcttaggaaacaggaaattttattggcagcaatccccaacctgaaagcagtaggcatctaaactaatccccaggcattggaattcagcaaccaggagaagcaagaagccatgtgtggtttttaatcactgtgatgttggtctttgtgtaaattcaaagaataaagttctcaaggttacgtggatgaccatgtaggtgagagggtgtgtgtaagctgaagggaggagggaagtagagctgaggggttaagaatagggactctggaggtaaactacacaaattcaaacaaattctttctctctctgagtctgttttctcctctgttaaatggaaaaccaacgacatctaccttatagggttgtcagaaggacagaacgtgaggatccagattaatgatatagcagaatgggatgtatatatcctgtttcattgtcattactatgattgtcaaggttttgaaaacaacaataacactcctttatcaattgttattgcaaaaactgaaagaatgcacaaagctgaatttgtaataatggctcccattttgtaaacttgtgtcaagaccatatgctttaaaatattatctataatcctagtaacagccttgtgatgtaggtattatttttcccacttattagataaggtatctaagaactatgactcagataatttcagtgccttgcccaaggtaacacagatagtaagaggtaaacttgggattaattccaaatcgccgtaactccaaagccctcattctctcaaccatcttgtgctgctacttttttgagaaaaggaaatattttgtagctcattgaaaagatctcttaattgggactgttttgtcctggctaaggtctcccaacacagtcttcttattctacctctgaatactttgtactaagatattcttcctctctagtttgggagtctttttaaaattttttaaaaatccttcatcattgaactttgtccccacttggtttttctgaatggtgctccccagcttctcttgtcctccagaaacatgtgccaaatgtgattgctcgctcattctactgcaccttaattgcaccatttcaaggggaagattgacttttgtgattaaaaactgcttgaatttctgggcaatcctcatatgaactgaccccaatttttgaatgctatatgcctaataatagactgaatggtgcgtgtatgtatgcgctttccactttagattccctgggttttgtcttctcttttaaatctaactgttcaatttgaatatccatagataaaaaaaatacaacaatataatgataatagcacaatggtcacaaagaaagaagagggttgtcctctagaagaaagcttttaacctaggggtccagacacattggtgcatttcaattatttgtgacatgtctcacaagagccataatttgatagtaataataatagttcaaatattgaaattagaaaatgatttactgttttctcacaaattggagtggcttcaaggttatccctctaattatgcccttttactcacttgcattctgatatacttcctggagcaggaaagaaaggggaagggctaaagctagtttcctaggaatcaagcttagaagcccaccttattaagacagtgttcagtgaaatgggcctactcataagaaatgtgttctgcatgtgaatgtgcatcatagcaaaaaaacgaaaagtaaacatttgagattgtcttctccaggaactagagattaggactaaacagattaattgcctttaagatcttcctcataacaccagtgtaaaaaaaaatggccatgttctaagatcccagattcaaggtctaaagtatttttaataacctgtcttacccatttaataagttttcaattcattttcattcatcttccacaatgtcttctgtggcagacactatttgcccatttttccttgataatgataacctgattttattcaggcaattaaaccagacctgaccttttacaactgattggtctagaggtgtttcatgtgacccagtcccgaccagctgggtaggaggaaatctgctggagtggttctggcacagattcttttttgcatgtcatataaagagaatgctcagtctcttacttcttaagtgatggtgtaaaaacatgaaatttagagctgctgtatccatattgaaattatgaggaaacacataacagtaagaaacaaatgatgatagaaggaaatgttaaataatctaggtttaatgacattattaaactttgtaataaccataatctggacttcttgttatgatttaagtcattgataataagatttgttacttgcaattaaaagtactccttttccaaatcccattttcatttctctatttccagcctaaaatagttcagatgaagacaacgtaatcagtctcttagatgaggttccacattctaaccatcttggtaacttcagctgcagctgtttctctccagcactagttgcttcacatcacacccatgttcaaaaatatgcagactctccttgctctggatattcatgctgtgggcactcggtgtagcactggcttatctaactcccaggtcataactttacttaagcatgactagtccatttgctgttgctcatctacaactagttgatcctgccttcataatttgaattctaaattattattttatcgatggaatcacactcaccccactcacatctattttgatctttaaaatccagagttttgaagcaaagtttttgttacttcaataaaaacagtgtttgtaggtatggatcaaatcaacatggtattgagatattgtttaacaattccctcagaaagaaatacaaaaatatgggcagagaggtcaatcaaaaaaggaggatgacacactgagagaatggctgcatggaggaaccaaaggaaagcccctttaataagtaaaagatcttgggcaccaggaggtcagagttttcatcctaggtaatcattgattgaggaccgatataagatggccattgattttagggagctctgtagccttttagagaaaatactggggcttagtagtgcagaactcaaaatctcatagcctaagagaaacacagtaacactgagtgaggagtcagccaagcaaagaagtagcagtgcccagtgtgtccatatgactgtcccctattcactcccatgagcagctgaaatgataagacatgtacaagccagtgcaatttgagttattcctgttcatataacatgatatgtataacacttggattgctaagctctagaaaatttttggctacaacagtagtccgttgtcctaagaaactatatttcaacgtatcttcaatcttttgaaaaatctaccattcaaaggaagaataaagaatttgttttgcaagaagatgctaaaatgtgttttcgtaggctcctattatttcaagattttcagagatggatctgccaatgtcatggagataatttgcactaacttggttttttttaatcttatcgttctgcttataatcatgccatgcttctgttttgttctcttttaaaatatctggttattatgccttgatttatttgaattaagcagaaacggtgacagaggcaacttgtcctgtgctagagttttggtgatttgaaaagactggtttttatttttacagaaatcttattgaaaatgttccagttaaggaaaacctgctctagaagtgatgcagacaatgcagtttaaatgatgagaaaatgtggtgaatgctaatgttttatagcttttaattattttgtcctttgggttcagcgaaatggttgtgtatcttagggtcacggagaacattcattttctaagtgtgtgtgtgtaatttttcttctttatttctttgttaattttttaaattgacagataatattttatgtttttatcaagcacaacatgcattctagcttatggaaaggcttttgcactgagtatagaaggctaggggtattttcagtgggtgaacttttatggataatgatatgaccaagctatagggcagcgtttatgaatgcatattttattggaactgataaagaagtgagatggtctgtggaatagacagtcaagagtttagatagtgaggtttttgcaacagcatggaaagaaaagtatcaatcttgcttctttgttcagatacctgatgtatcttggtttcaggcttttcaatttattgttcaaaatgctaccagggaagacaaatgactaactccagttgtcttgtaacaacagtaaagctttggttagggagtttacaattggacttagaagacagactgcgcaagttcttcaaatccaaatttaataatagataaatgttgattaggattctttattttcttaagttaacttttagtatctggtattaatgtagttaggtgcaaaagagttctatgaatttgcaagtaccacagtcaaataattgttttgaatatataaacaaccatgaaaccaaatatatttatgaaataatacagtagttgttgctttgtattaacgctataaaaggggtctagaagtagactcttgatggcatcaagctgtcttgaagtccctattactctcatttgggccaataaaattatacattatttgttggacagtgtctacaactccaatgaacattcatacgctgaagaattccacatcttcagctctgacatttgggttccattattatcatatttccaattgccttttggaaatttacacttagatgtgctataaggatctcaaatgcaagccaaactttctccccagcagtgtagcataatgattaaaagtgattaaaaacacagacttcagaagcaaatagtctatgttgaaaacttttctctgtcacttattaaacaagtgaccatggatgatttatttaacttttctgggcctcagttttcccatctgaaaaacaggcataataatcatatctacctaatgaagtagacatgacaattacataaattatacggttatatatttatttaaacatttgtaatagtgtctggcacatacatatattaaaaacaggcacaataatcatatctacctaataaacttgttgacatgacaattacataagttatataactatatatattatataaatataaacatttgttatagtctgccacatagtatgcactatatataaacttttaagtactattacagtagcctccaaatctgtgcctattccactcatagtcaccacaatgtatttattgtatctcctaaagctcttaaatgtaaacccccttctttgactttacatctgcctaattaatgcaaatcaatgtcctttttacatgaaccattgaaatagcctcccattggtctcatagagttgtttccctttctttaatttatccaggattatctttctaaaatatgatttggataattactttcctgttttacaaacttcaagcagcaatagtaaccatagaataagttcagagtattgagcatgttatagtctcaaactatgattttgccaatcttattttccaccaatacaacttactcaccgtttctttctcacagtatgaaatgaaagtcatgcttccatgagtagatgtttgcctttcttccaagagtttctttcttgaattcacactgttctttaagactcagcttgattatctaagtcattttccagggagatggtgatgatatccccaacaccattctcctctttcaagtagtgatcatgaccagtttctttgtgcaccctgttgtattttgcccatacactgtactcctattatagcacttaccaaagtgaactgctattgtcttgccctgatcttcactaggaaaatgaatataaaacaaaagatgtaggataagaaaaactctaattgtacttgattgttggctcacatttaagtagtgattacattttttaaaagattctggagaaatgactatttttttctttgattctgtgaatctaatagatcatgacactttgcaagcaggtttggcatgccagagtaagcaaaggaaggagtgagagaagaatgctaccttaatcaaaacaggttcagatggactgccctgtcctatatccaaaaaaactcaaaaaacaaacaaaaaccatgtattagttattctgatgttgtctttgataagaactaagaacattaaaaagagggaggctgctgattcaaatatcctgcaaagattttgaaggaaagcaatgatcaggggccatctcaatgagtatgttgaagctgaggggaaacagttatttctggagcaagtttagaaaatgaattgccctcagaattaggtagatattgtatcctggagtatttgattccgttgatactagaatcttaatgctttgtttcactttcctgattttgatacttaaacgtgcttcgtaaaccatctgaaaccaaagctacaggattgtctgaatttaacctaatgataccagggaaataacgcataattatttctgctctccttagcagaatttaaattctctctcttctgtcagaaagatgacaaaaaaaaatgactcatgtcaagaatcaatttgtcacatctataaccttgacactattgaaaataagtatatagtgagatgactggggactttaaggggttggaagaggcttgacagaaggaagtctgatttataacctttctcatctatgaactttccaaagactttcatctaatgttcttcctggatcccagccctgaatttagttaacctttgtggctgtgccaatttatccacacctttgagttctatctcactccagaatatgaaaccaatcttggccaaagacagaagcctataaggcatctttggcaggtggcataacagtttagcattgagttattctccttaccaacggtgtgtgttagtgagcctattcgatcccttataattgtgctctgaatgataagggatcaaataggcccactaacacagctgtcaagtaactggaagacagcatagactagtagaaagagttttcctttttttttttctcttttttcttttctttttagacggagtctcgctctgtcgcccaggctggaatgcagtggcgcgatctcggctcactgcaagctccgcctcccgggttcacgccattctcctgcctcagcctcccaagtagctgggactacaggtgcccgctaccatgcctggctaattttttttgtattttgtagtagagacggggtttcatcgtgttagccaggatggtctccatctcctgacctcgtgatccgctcgcctcggcctctcaaagtgctgggattacaggcgtaagccaccgcgccctgcctagaaagagcttttcagctgtaaattgagactaaatattcaatgtacattttggctaccgaataattttttcctagttacttaatgtttctgagctcaaatttctttgtgcagtatgcaggttggactgaatgacttataaagtcccaaccagttctacaattttaagattaataactgctactttttcctctaggtcctccacagaccctttaaaatcatgacagattatatcagtgactagatttctgtctttaaattcttatgtttagttccttgatacatgcaaactgttttcctacccatacataatgaatattctcttgatttaatgcagatttgggggacacattcctatattaatattttctcctatccttgacactttctataaactaagtacatcctagcttagtgtaattttttgagtctgtcctataacctatcactagcctctctttggtaactcttctaaactctcaatgagcaagaaaaacattaccaacttacgtacattatgcgctcaaactactattattgtactgcagtttttataatataaataatttgtatgattatttgatgaattatataatgataggttacttttggcattagcaagattatttataataaaatgcagtgtggtggtattttgggaaaaagtaacctgaacaccaaaacttttattcttgattaataaagaggataatatgaaatatcctggaagggaactgtatattatttatgacaaaataagtcaaatggaattgagcaatggatttctcttaatcaaatcaatgtatttgagcaccttccaactgaaaaagcaaggaattagttgaatatcccaacccaaaccaatctaataataatttatttcaattttctagaacccaatatttaccttaacacataaagagcatttctgaatctgtaagaaaggaaggccctaaacagtcattgtgttgcaaaaatccacatgatctgtactcttcaatgtggaatgtacttacctcttgtacttctaagccacaagaaattttaaagtactagtcaatattgtttcataacagttgggaatttggcagatagttattgagggacatttgatgacctctagccccagattagtttaaaacattgttaatctataaactacaggcatgttctgctctcacacttactccaacataacagaaaacaggaaaaacatatcactttattatgtgttttttatattaatggccactattcactctgatgttattatagattatgttgttcaacatatactgactctttcatatcactgagcagagactagatgatatttggtacaaatggaaaagtagtaaaatatttattcagaaagtatgtgagttcattttacttagagacctgtgattacacacatgtggttttagcaaaaacagaattgagatgcataggcctttatcccggcagtgaaacaatttttttttctgatttaaaaaattatactctaagcagttgagggattttcagattcccagttaaattttgggattatatcctgttcaaaaatcagtttgtgaaacttgcaatgccattcacaaaagaaaatgatatttcagatggtgatatgctttctcagcctgttcattgaacccttcttgtttaactcatgtttcatgtgaagtatttaagtcacagtaatccagaatgccacaataataattagtatttactgattcttgaccatgccaaaagtattatatccattatcacatttaatcctgaaaataaaccaaacaaatcttatggatatagataagaaaaagaagattacttatcctttccaagaccacaaatcttgtcaaaccttgcaagccaatatttacatagttcaaatgcacagtaagcagtgcttattatgtgctaggcattgttaaatagctttagatatatttaaatcatttgccatcagaagtctgtactgtaggtcttactattatcctcattttacagatgaagcacaaagatccatagtcacatattttgtaacaagagcaggatctgcagccaggcagtctgggtccatggtccatgttcttacccatggtgcaatactgactcttgaagtccagggtctactaagaatccaggtctacctgactccaaagccagtgcttattttactactcactgctgtcactctaacgacatgtagaacagcttatggaataagaaaatgcgttcaatatgccaagtcaagatgcctggaatatttaagctacccacgtgattcccatgcagaaaataaagccagagtctgcattttccccccaggctaaggaagaaaaattcagtttgctagaaacaatctcaaagacctgtactaggggtttgtatggggaaggaggccaggatttgtgcaagtataaactctggattcagttccaagttcagaatgttactctggttagttccactgactgctccctcccccatttcatatttagtatcttgattaaattgattctgatctttccttcccaaatatgactatggtcagtcttggaagatatcttccacctgttggaaacttaaccaaacacaaagagtcctgaaatcttttaaagatgtttacaatttgcaacaatggggagaaaaaaaaatggggtaaaagcagcattttgaaaagaattaacccttgtgtatgtcttatttctagaactggtgtttctggctcactccattttaacagagaatgttcaccttatataattgcctgccccaagccctcgtcacctgttttggttttttgtttgcttactgaaatggtatatttaaaatatatgtttcacaagggtgtttactcaaaggagtacattttactagatttcagagaagaactctatacttatctgttcatgtttcattaaagcaggtttatttaaaaatcattaaaataacatttagggttggatgcaaggtaggctctcttgtgatgtggggagcagttggagatgcattagaacttgggaatgattgcaagtagattgccaatggcagaggaattaaaacagaaggaagcatccaggaggctgagatgggcagatcaagaagtcaagagatcgagaccatcctggccaacatggtgaaaccctgtctctactaaaaatacaaaaattagccaggtgtggtggcaggtgcctatagtgtcccaactactcgggaggctgaggcaggagaatcgcttgaacccaggaggcagaggttgcagtgagtcaagatcgtgccactgcactccagtctggtgacagacagaaactccctctcaaaaacaacaacaacaacaacaaaagaagcatccattagcacatacaaatttattttcattgcctcttttctttctctttatcaatatatcttctgacctgaacttcttgcaaggagaagtgagaaatgggctttgggtaagagaataagaactgaaaaaatatttagcatagacaaattttgtattgctaagctaaaatcagtcatttatttatacttaaagaatctttacgtttgtgagacagtaaaatgctctggttaggagtacaggctctggaataaaaaaacctagatttaaatctggattccacaacatactcatggtagtacctcacggaccagttactcaagttttgcctcaggttttaatttgcaaagttgtggtaaaacaacagagattgctacaattattataaagattaaataaagtaaaatatataaagaacttaaaacattttccgatatataacaagcgctagtaaggattaatttttgttattgttgcttctgttgataatagttatgtctttttttctttttctttttttttttttgagacggagtctcgctctgtggcccaggctggagagcagtggcgtgatctcggctcactgcaagctccgcctcctgggctcacgccatccttctgcctcagcttcccaagtagctgggactacaggcgcccaccaccgtgcctggctaatttttttgtatttttagtagagacggagtttcaccatgttagccaggatggtctcgatctcctgacctcgtgatccacccacctcagcctcccaaagtgtagttatgtcgtttttaatatgcattgtgatccagatgctgggatgatagttttacacagaggatctatacaaagcacaactgtacatataacctcaaatattactgctaggattctctaaaagaagtaatattattttatgaagtgacataggacaaacaaaatcctcaatgacattacatcaaacctattcgctgcatgcaactagcagggtgaatggtagggcgtggacacaaatctttctgtcaatatttccatttactctggcttgtggacccatggacacagacaagatgggaaccctgaagggttcagccaccacaggtcactactttatgattcaatttcatctttagggcaggaacctctttacaaagtgtatgggtgagctttggagtcagtaagcagtgcaatcttcccccagttttatcttagaataggtatgtgaacatgagcaaattattaacctttcatgagacatagccccatcatttgtaaaatggagataaaagtatctacacattaggtaagtaacaactaaaggagatgttgtatataaaacatagcaccttacagatattgatttagcaagccagctattcttatattattatatttaatcttcaagttggaaaaccaggaacaaatttaccttttttagaacaactaatttatgtatgtatgcatttttatatgtaggcaaatacctcttctataaatgtccctaggaattgttgctaaagcaaaatcctttcttcttgagaaagcctttaaagtctgaaaggttggcaaaggaagattcttaagtcctcttgtatgaattagcagacaatttttctcggctttcaaatcacccttcccaaaacaaaccacaaatagtcccaatatttgcacagatccctcaaagagaaacaaactacagtttccctggagctcgtttgtcacttttccctttcttttagcatactccgaggcacttaatgccattaggcaaaattatgccatccatggcattgcacctggcatggctagtgttcccaggtggagaagcagatgtataatggggctattcgaaaatgctacattggaaaaacagctatacaaacaaaattagtgagacaacactgaagattgctcttccttctattccagcataatttatcttccagaaaaaagaattactgcatgaaccatggatgagcataattaagggggaaggcaaagtggaggagttttgtagccgcatcccgtgtacattgtgcagggagagagaagggaaaccaaagcattcactcatatgtccatgcatattaagccatttagctggcatatggaatgtttcaggttgttccagggatatagacaaggaactaaatattgactcagcaagagctcaaatgagaggtctaattaaattaaatggtacaaaggggaggcttgtttcatagactccagtaattgcttaaaacacaaaagagaccaaataatgctcaaagaagtatagtaacaaacaagaaaatatctgtctatctatctatctatctatctatctatctatctatctatctatcatctatctatcatctatttatcatctatctataaatatctacacactaggtaagtaacagctaaaggagatgatgtatataaaacatagcaccttacagagattgatttagcaagttagctattctaatattattatatttaatcttcaggttgaaaaaccaggcacaaatttaccttgtttagaacaactaatttatatatgtatgcatttttatatgtaggcaaatacctcttctataaatgtgtgtgtgtgtgtgtgtatatatatatatatagtgagagggagagaagacatgagcataaaagttaccaagagttcaaaggctatggttggctcaattgtgaaaaatggttggaatttgttatgacaatatataatcagtggtgcctttaagcagtctggcgatgacacatgcatcagcatgttagttttaattttacgttaatgactgcctatctgcagaaatgccttaggataatgtcctttctttggacaaacttgattgatacttcacgaattataggagcaatggttctgaactctaaaaatgctgtgctttaagtcctgcccaaggaaagagtgagggtgagggaccatgaagatgattctggtgtactagggttgtctatttcagaataatacattgagaatgttggacagcatttatagaaatagacagatttcatctctgacccaaaagcactattgctgagtgttgggcatgccagagcccatcttggataaaagggagatgcaggatggaactggggaatgaggagaaaagaggctctttttcttccttgtaccttagctctctgagccttagtctgtcatctataaaatcagaataataatgggaccttcttcattggtttgaagatttaaataacatatttaagggatgtaaaaccacttctggtcattatttagagctcaataaatgttagttgtcattgtggttaccattactcttaccgtaatactcacagaaatgaagaataagaaccctgtcctaaaagagtgtttcatctgctcaaagggaaagataggaaccctggatctgctcaattttacattttcactaaagcttccatgcccctctgctgggcaacttaacattaaatgtacatactttagaatgagggaactgggtttaagatatggctctgcctcttaatagctttgtgaccttggatagttgttagacctctttaagttgcaattttcatatctataagattgtaataataatagctattccatggaggattttttggtaagtataaaaaatgtcaatgcattttaaatatttagaacagtgcctagcattaataagcactcattttcatgtactatacaggcatatgcatatattacatatatagtttacaaatgtaaaccaaactgacatgcacacacacatattccacccttcattcttttagctttaaataaaattacaaacttttttagcatgatgaaacctagttatatcactgaatctctctgtctctgtctctgtttctctctctctcactcaatcacactctcaaatatacaagcatatgctagcaaagcgttagttattatctggatctctacttacactacttcctaatttaaacaaatcttttaaaatttattattaaaaacatcaccttgcattcttagaacatttatattttcaggtcagttacatagacattttctctctccatctaaccaaattctaattctttattatttagtgcaaattttctgtgaaattctttaggctattcaaatgaaagtactttatttcctgcaaatctttggcatctattgtccaaaacatttattaattctgtactgctcctaaacatttctgtaaatataatgggctgttgtaccctgccctacatcttaaaagtccttgctactagaagtgttaatcttgccaaaaaaatgacttctttgaatttctaggtagttaaagttctattctgtacagtaattgaatatttctgacatgtaaccttatataaacactctaatagcaaataaaaatgtctctatgtccattgttgaaatctcagggctaaatgtctccatttgtattaggaacaagtagattaaagtccaaccatccttctgaagagcttttcccttgtgctgaatacagttaatgacagcctaagtcttttgtttgttttttttttttttgtagaattcatccattactcatcagctatatctgaaacaaactctaatcttggtacagaagcagagaacattattcttcctcaaagcctatgccacgtgttgctgctaaaacaggaatggacaaaaaaacagtttcataataaatagagaaatgagcttactaaaggcacggcattttcttaccttttttctttacacataatttgaaataactcttacaacaattagatgaaatatatcagtgaataatatcactttagggtaaatttaacatttatccaatattagctaattccatgactactgccatgactactacgactattattaataataataatcacaaatatttaatgagcacctgctacatgctggacactaggctaagcaacttacgtgtagtagaatttccctcctggaaggtatttattgtccagtgagcaacctttctattcttccctttccttgtacataaatgatggaggcctcattagtgagattccagaaagtacataatccctggtccatgtgtaaaaatgtagagaaaagctccctaccaacctgtattaaacttaaacgcaagtgaaatttaaacttttgttgtgttgagtcactgagaattggtagctgtttgttaccacagcataacctagcctaaattgcctaattcagtgttattgactgaaacaaacctttcttacacgtttttcaatcatattcattccatgttatgtgaatgagagcctgaggctagcatatacataatttatctctgtgttgaagaggaatagacttgaactctacagctggttggaagtataagtgagggtcctaaaacttgcatgagacaaagtcaattttgtagtcagtgataagaaataccatgtgcgcggccaggcgcggtggcttacgcctgtaatcccagcactttgggaggccaaggtgggcggatcacgaggtcaggagatcgagatcatcctggctaacacggtgaaaccccgtctctactaaaaatatttttaaaaaattagctgggcgtggtggtgggcgcctgtagtcccagctactcgggagactgaggcaggagaatggcatgaccccgggaggcggagcttgcagtgagccgagatcatgccactgcactccagcctgggcaacagagcgagactccatctcaaaaaaaaaaaaaaaaaaagaaagaaagaaataccacgtaagcgcatgcatgcacaccccccccaacatagtaggtgctcaatgtctacacaatgtatgaatatatacatagaaagagtatagatcactttttaaaaaacactgaatgttgctagaaaactcaaccacgaattgcctgtgacccagggcttgaccaaagcttccttaagacatcaaatattgcaaagagacaacttaatgcacttattcccctatggttgtcagtgtttttttttgtgattagctagatcatcagaaagtaacatttccaggtcatattattaccacaaatccgtgctaaagagccttcactaagttgaaatttaatgtaacttcaggttttattgagggtcaatgaagaaatgtctatttgaacatttctgtcttttacagacccctaggttaggacattgttaccatttgttaccatttgttattcatgttaccatttgttattcaaataattaccatacacaataagtttctctttaaatttgaagcctgaaaaaatgttctgtcttaagaaatgtctatgctgtctatcaacaagtaatgacaactctaaactataattacttattaatttctagttaagtttactcatctagagtaactaattaatcccaaaagtctttatacttttgaaaattctttagagcttgtttctattttgagtttcaaatttttatatttttcttgatttctgaaactgttgtaatttttcagaagcaggtggaaacaaactctatttatgaaataaaacttcctgtaatttattattattttttgcttgtcttttctttctggctgcatttctagagaacaaagaccttgcttattcatctctgcggtgttgtttcagagcaggcaaaatgagaataaatatatgttagcatggaatgacacaaagagctctgaaaataaagcccaaattcacattttcgctccatcagttactaaccatgtgacatttggcaagttatgttcatttattagcctttcttttcttgtcaacaaaatatcataagtttacttgtagcactgttgggaggatagagaatatatataaatgtgtcaataagagtattcaccaaatcagcaaatactcctgtcaccttttctccacctataaagtgacagtaaaggacacaatgatgctactatttgtctcttgagtaggtacccacaaagagagcctgagagaaatttactcatgtgctttactgaaggtctgttctcagaaggggagggaagaaaaaagcatggggaggtagggcctggaactaataagaaaattattaatctaagtctgagactagctttacctgacctcagagcgggttgtgaaattgtacagcagagttggttccatcttgaagcaaggagcctgagctttatatccttctctcagtcagttattagcgattggttgtcagagcatgcaggggtggtggtgcataaccactcatacatagtgactcctgcttggctgacaacattatccagaagaaggagcagctgtgagatgttagcagccaacactcacagtagcaggaaaatgggcaaccaggtaaagggatggccactggcatcagagtgggtggagactggaaatgttgttaaacactctacaatgttcaaggaagccccccacaacaaagaattatccagcccccaaagtcaatagtgctgcagatgagaaactgtggaacagatgaaagcatgaaaaaaatcaatgtttaataattattactaggagttattgatttgctattaataacattcagacattagtaatcaaaagggaaaatatggaatttcattgattttgctagggaacacacacacacacacacacaaacaacctcacagtttttatcctgtgactttagtattctttcatattatgcaacaacaagcataaattcagcatgagtcagactgaaatgactacttttgcaaatatcatccatacagtcttgtgcctttttccacatctgctttcagttctgccttatacatgcctttatagattttgacgccagcactttactatcctagaatctacagctacttgatttttttttttgtcttctctccccttttcttctgtgtttttccctggctttcagctcaactcgtgaacatcaggatgtctgcatccagctctgtttttttccttcagctgcactttgcctaatggggaatttggcacattcctatagttgtcaaatacatcttgttcactttcatggcctctcatttcatctctggctttgaagttctatagttcaggttgtttagcacacaagagaaataattaatctcctccctcttttctaaggattgataacaaccaagctaattatttactccagaacagaaataattgtttatgctaagttttaaattcaggcaaaattccttttgaataatatggaactatttgacatatgaataagaatatagtaattattgtaaggagtacatttaacagtagagactctcacatcacatctatacttttttttatctccccccttcatttctttccttcccatatccaggtttgtgtgtgtgtgcttcatccagatttttttttctatctctgtaattgcacaaaagggatctaatttcacaaaacagatcactgccatttgtgagagagataccacagcagtctcagtaaaccatgtcaaatcaattctcaaatcataaacaatatattgtaccattttggtacacatgtacttttttctaggtttgcaattagcaggtaactcctgaaggagctgatctcattctcactgatgcagattgcttaagcaaaattggagaagcaccctcttaaaatcaatcaaaatgaaacaaaactgccttctgtagcataatataatttgtcagttggtactgagaagagtaatttggatagcaactgtgaagggaaaggtaaaacaaagaagaataagatcagagattctgatttggaaggaaccacgaggctcatttcatcccaaacttgatagatgaagaaatggacccaaagagattaatgtctagactataacaggtcttataatttggggtccagcagcttttctatagcctcatgttagcttctcattttgaggctgaagtgtctgttctgattagttcttcttaagaatccagaatcattaaatcatcactattattaatactgtgctctagtctgtgtttccccacatctttcaattaaaatcattccttagctcttgatgtatgtagcaaccatcctagcagggtatgctaataccacccactcctctcctacctcccacccctgtcatctcagcactaaagtcaccgagaggtcatagggcttcatttcagtagcaatgaagtaaagaacatgagacctagaatgaaataaagaacatgagattctaggtcaggcgcggtggcttacgcctgtaatcccagcactttgggaggccgaggtgagcggaccacgaggtcaggagatcgagaccatcctggctaacacggtgaaaccccgtctctactaaaaatacaaaaaaattagccgggcgtgatggcgggcacctgtagtcccagctacttaggaggctgagacaggagaatggcatgaacccgggaggcggagcttgcagtgagccgagatggcaccattgcactccagaccgggcgacagagcgaggctccgcctcaaaaaaaaaaaaaaaaaaaatccctcacctatttcattgtttataaaatgaatatgagatagatagctataacataaagagattatttctaaggtttcttcaagtaccattataactgaatgcattgcacaatcaaaaagaaaatccaattcattgtaatattagtttacctagatatcaaggaaatgccttagtccactttattacaatgcaatacaaaagaaaaaaaggaagaacagcacccccacatgcattttttgaagtatatcctttaaattactaaggtctgattacttccatgtacctcctgcttaagattaaaagaaacaaaaagcaacactcaatagggttgaatttactgaagcatcttctttcttctctttcctttttctttcttttattcctcctcttcttgcttctcctcctttccctttcttcatttcttttgcttctctcccttccacttcatacttcttcccgtctttctttctctataaatattccagttaattttccaatttttttttaattttccctgttttctttctgtctacaaatgattgcagtaggttcagaaagctcattaactattttccttaatgctttaacaaagcaaacacattaacctactgtcattctgtaagtacttgattgcctacattctgtaagccctcatggctcttttggtcaatagctgaattattgctgtttcctatctttcctaattgaatgaacatggccccttgatttctgttgaagctgagttgcagttgcttggcgaattttcagtctttctgatctttcccctttgactgattagttttatttatcatccagttttttaaattgtggctttggcacacctgcctcaggctaagagaacgtgattaaacacattaaaagaaatccacagaacagagtggttacataattaatcagtcttgagcagtaccaaaaaaatgctgacccaaaagcatgacatttggggaaagggtaattttaagagtttaaaaacattctaatgaattgatttttgttcctgaatttcctttttcatatatacaggctagaatataacaatagttatttctttatagcaagtctccttttacaaaatacaacagtttcccactaggcgtggtgtataggaatactaggtgaacagttgatgaagaatctgctccctgatgagaatgccttgaggtaagtcagatacattttaatcttcttagagttatattttttattctatttctaatttaggacattcatacatcaagatgactaggggaactgaactgcaacagtatgtattttccatagaaatttttatatactcacctcttttttttttagtgttttttcttttattatactttaagttctaggatacatgtgcacaatgtgcaggtttgttacatatgtatacatgtgccaagttggtgtgctgcacccattaactcatcatttacattaggtatatctcctaatgctatccctcccccctccacccaccccatgacaggccccggtgtgtgatgttccccaccctgtgtccaagtattctcattgttcaattcccacctatgagtaagaacatgcagtgtttggttttctgtccttgtgttagtttgctcagaatgatagttgcaagcttcatccatgtccctacaaaggtcacgaactcatccttttttatggctgcatagtattccatggtgtatatgtgccacattttcttaatccagtctatcattgatggacatttgggttggttccaagtctttgctattgtgaatagtgccacaataaacatatgtgtgcatgtgtctttatagcagcatgatttatactcctttgggtatatacccagtaatgggatggctgggtcaaatggtatttctagttctagatccttgaggaatcaccacactgtcttccacaatggttgaactagtttacagtcccaccaccagtgtaaaagtgttcctatttctccacatcctctccagcacctgttgtttcctgactttttaatgatcgccattctaactggtgtgagatggtatctcactgtggttttgatttgcatttctctgatcgtcagtgatgatgaatattttttcatgtgtctgttggctgcataaatgtcttcttttgagaaatgtctgttcatatccttcgcccactttttgatggggctgtttgattttttcttgtaaatttgtttaagttctttgtagattctggatattagacctttgtcagatgggtagattgcaaaaattttctcccattctgtaggttgcctgctcactctgatggtagtttcttttgctgtgcagaagctctttagtttaattagatcccattcatctattttggcttttgttgccactgcttttgttgttttagtcatgaagtccttgcccgtgcctatgtcctgaatggtattgcctaggttttcttctagagtttttacggttttaggtctaacatttaagtctttaatccatcttgacttaatttttgtataaggtgtaaggaagggatccagtttcagctttctacatataactagccagttttcccagcaccatttattaaatagggaatcatttccccatttcttgtttttgtcagaattgtcaaagatcagatggttgtagatgtgtggtagtatttctgagggctctgttctgttccattggtctatatctctgttttggtaccagtaccatgctgtttggttactgtagccttgtagcatagtttgaagtcaggtagcatgatgcctccagctttgttcttttggcttaggattttcatggcaatgtgggctcttttttgattccatatgagctttaaagtattttttttccaattctgtgaaggaagtcattggtatcttgatgcagatggcattgaatctataaattatcttgggcagtatgaccattttcacaatattgattcttcctatccatgagcatggaatgttcttccatttgtttgtgtcctcttttatttcattgagcagtggtttgtagatctccttgaagaggtccttcacatcccttgtaagttggacttctaggtattttattctctttgaagcaattgtgaatgggagttcactcatgatttggctctctgtttgtctgttattggcgtataggaatgcttgtgatttttgcacattgaatttgtatcctgagacattgctgaagttgcctatcagcttaaggagattttgggttgagacgatggggttttctaactatacaatcatgtcatctgcaaacagggacaatttgacttcctcttttcctaattgaataccctttattttcttctcctgcctgattgccctggccagaacttccaacactatgttgaataggagtggtgagagaaggcatccctgtcttgcgccagttttcaaagggaatgcttccagttgttgcccattcagtatgatattggctgagggtttgtcataaatagctcttattattttgagatatggcccatcaatacctagtttattgagagtttttagcatgaagtgctgttgaattttgtcaaaggccttttctgcatctattgagacaatcatgtagtttttgccattggttctgtttgtgtgatggattacgtttattgatttgcatatgttgaaccagcgtttcatcccagggatgaagcctacttgatcatggtggataagctttttgatgtgccgctggattcagtttgccagtattttactgaggattttggcatcaatgttcatcagggatattggtctaaaattctctttttttgttgtgtctctgccaggctttggtatcaggatgatgctggcctcataaaatgagttagggaggatttcgtctttttccattgattggaatagtttcagaaggaatggaactggctcctctttgtgcctctgggagaatttggctgtgaatccttctggtcctggactttttttggttggtatgctattaattattgcctcaatttcagagactgttattggtctattcagggattcaacttcttcctggtttagtcttgggagggtgtatgtgtccagcaatttattcatttcttctagattgtctagtttatttgtgtagaggtgtttatagtattctctgatggtagtttgtacttctgtgggataagtggtgagatcccctttatcattttttattgcatctatttgattattctctcttttcttctttattagtctttctagcggtctatcaattttgttgatcttttcaaaaaaccagctcctggattcattgaatttttgaagggttttttgtgtctctgtttccttcagttctgctctgatcttagttattcttgccttctgctagattttgaatgtgtttgctcttgcttctctagttcttttaattgtgatgttagggtgtcaattttagatctttcctgctttctcttgtgggcatttagtgctataaatttccctctacacactgctttaaatgtgtcccagagattctggtatgttgtgtctttgttctcattggtttcaaagaacatctttatttctgccttcattttgttatatacccagtagtcatccaggagcaggttgctcagtatccatgtggttgagtggttttgagtgagtttcttaatcctgagtcctagtttgattgcactgtggtctgagagacagtttgctataatttctgttcttttacatttgctgaggagtgctttacttccaactatgttgtcaattttggaataagtgcgacgttgtgctgagaagaatgtatattctattgatttggggtggagagttctgtagatgtctattaggtctgcttggtgcagagctgagttcaagtcctggatatccttgttaactttctgtcccgttgatgtgtctaatgttgacagtggggtgttaaaatctcccattattattgtgtgggagtctaagtctctttgtaggtctctaaggacttgctttatgagtctgggtgcttctgtattgggtgcatatatatttaggacagttatctcttcttgttgaattgatccctttaccattatgtaatggccttctttgtgtctttttatctttgtttggtttcaagtctgttttatcagagactaggattgcaacccctgcctttttttgttttccatttgcttggcagatcttcctccatccctttattttgagcctatgtgtgtctctgcacgtgagatgggtctcctgaatacagcatgctgatgagtcttgactctttatccaatttgccagtctgtgtcttttaattggagcatttagcccatttgcatttaaggttaatattgttatgtgtgaatttgatcctgtcattatgatgttagctggttattttgcttgttagttgatgcagtttctttctagcctcgatggtctttacaatttagcatgtttttgcagtggctggtaccggttgttcctttccatgtttagtgcttccttcaggagctcttgtaaggcaggcctggtggtgacaaaatatctcagcatttgcttgtctgtaaaggattttatacctccttcacttatgaagcttagtttggctggatatcaaattctgggttgaatattcttttctttaagaatgttgaatattggccctctcttctggcttgtagagtttctgccgagagatctgctgttagtctgatgggcttccctctgtgggtaacccgacctttctctctggttgcccttaattttttccttcatttcaactttggtgaatctgacaattatgtgtcttggaactgttcttcttgaggagtatctttgtggtgttctctgtatttcctgaatttgaatgttggcctgccttgctaggttggggaagttcacctggataataccctgaagagtgttttccagcttggttctattctccccgtcactttcaggtacaccaatcagatgtagatttggtcttttcacatagtcccatatttcttggaggctttatttgtttctttttactcttttttctctaaacttctcttctcacttcatttcattcatttgatcttcaatcactgataccctttcttccacttgattgaaccagctgctgaagcttgtgcatgtgccatgtagttctcgtgccatggttttcagctccatcaggtcatttaaggtcttctctatgctgtttattctagttagccattcgtcaaattttttttcaaggtttttagcttctttgcaatgggttcaaacatcctcctttagcttggagaagtttgttattaccgatcatctgaagccttcttctctcaactcgtcaaagtcattccccgtccagctttgttccattgctggtgaggcgctgcgttcctttgtaggagaagagatgctctgatttttagaattttcagcttttctgctgtggtttctccccatctttgtggttttatctacctttggtctttgatgatggtgacgtacagatggggttttggtgtggatgtcctttctgtttgttagttttccttctaccagtcaggatgctaagctgcaggtgtgttggagtttgctggaggtccactccagacccagtttgcctggatatcaccagaggaggctgcagaacagcaaatattgcagaacggcaagtgctgctgcctgatccctcctctggaagctttgtctcagaggggcaaccaggcgtatgaggtgtcagtcagcccctactgggaggtgtctcccagttaggctactcagggttcagagacccacttgaggaggcagtctgtccgttctcagatctcaaactccatgctgggaaaaccattgctctcttgaaagctatcagacagggacgtttaagtctgcagaagtttctgctgccttttgttcagctatgccctgcccccagaggtgaagtctacagaggcaggcaggcttccttgagctgcggtgggctccacccagtttgagcttcctggctgctttgtttacctactcaagcctcagcaatggcagacgcccctcccacagccttgctgccaccttgcagttcaatctcagactgctgtgccagcagtgagtgaggctctgtgggagtgggaccctccgagccaggtgtgggatataatctcctggtgcgccatttgctaagaccattggaaaagcacagtattagggtgggagtgtcccaattttccagttaccatctgtcacatcttcccttggctaggaaagggaattccccgaccccttgtgcttcctgggtgaggcaatgcccctccctgcttcagctaacactccatgggctgtacccactgtccaacaagccccagtgagatgaacccagtacctcagttggaaatgcagaaatcacccatcttctgtatcgctcatgctgggagctgtggactggagctgtttctatttggccatcttggaacctcctcccttttttagtgttttgagacaaggtctggctctatcacccagggtggaatgcagtggcatgatctcagctcactgcaacctccacctcctgggttcaggtcatcctctcacctcagcttcccgagtagctgggactacaggcatacaccaccacacctggctaatatttgtagaaatgggatttgccatgttgcccatggttggtcttgaactcataagctcaagcaatccacctgcctcagcctccccaagtgctgggattacagccctgagccaccgtacctggcaactcccctctttatttgataaaggatagcaggtggaaggccaaactggcttcatttccatgtgaactgaagctgcatcaggttccaagatccagacaatgtcctggagcttggctctggtaaaaaatgtctatcatatgctatctctgttcatgatctcaaaaacttgctgtgaacttagcttattttctcttctaagcagtgttgagaaaagtgattgagatgtggacatccttattttgttctattgctaaaatgaaacttgaatagagtgctcatatcttaattttaacagaaaactactctttccattttaccaaacatgggatttatcagcaagaaattcttcaacctttcattcatttctataaatgtgattctatctttttttaagttagactaaatcaattttttatttatttttaagattcagggggtacggctgggtgcagcggctcacacctgtaatcccagcactttgggaggccgaggtgggtggatcacaaggtcaggaggtcgagaccacggtgaaaccccgtctctactaaaaaatacaaaaaattagccaggcgccgtggggggcacctgtagtcccacctactcggtaggctgaggcaggagaatggcatgaacccaggaggcggagcttgcagtgagccgagatcacgccactgcactccagcctgggtgacagagcgagactccgtctcaacaacaaaaaaaaagattcagggggtacatgtgcagttttgttacaagggtatatagcatgatgctgaggtctgggcttctattaatttcatctctcaaatagtgaacatagtacccaacaggaattttttcagctcttacccctctccctcttaccttttagagactccagtatctactgttcccatctttatgtccctgtgtaattaatgttcacctcccacttgtaagtgaggacatgtggtatttgattttctgttttagcattaatttgcttaggataatggtctccagctgcattcatgtggatgtgaaggacataattaaattcttttatatgactgcatagtatgccatggtgtatatgtaccacattttctttatttaataaatgtgattatatcttaattcaacttcatcctggctgagaagaagagctcttttttctttttttccaaacctaatctttctacccgttctaacatcacattctctcatttgcttgactttattccatcagttgtagtcttaatttttcacaggttcattctcttctggtcgcttttttttctttacctaaacatttctcaattactgccactttaggcagtatataaataaaaatgttaacaaacaaaaatgcttttggtgactctgtctgctctgaccctcaagtatctctttctttctttctctctcttttattcctttcaacttcaaacttttggaaaattgagtctgtgccaccatattttatctgtcattgcatactcagtactcaactgatcatgatacaatttttgccttcaccataatactgatactgcttttaaaaagatataaaaacaccttctaaatgcaaaacccaatgtgtacttttaaggctaagccaacctgcataattttgccggttgcatcctttatagtcgttggccactgcaccataaatcatgtaaaaatattcaaggactttatagtctagaggggaatatgtgcaaaaatatgactatgatatgtgtactgctgtgattttggtaatcatagagggaatatgatagaaactgttagctgccacccaatatccattctctttttcatagaaacagaactctgattacactggggaaagcaatgtgcaggattaacacacaaacaaacatacaaaatttatattttgtagcataccttgcagtgaaatataacagtatgactaagctctagcgaatagtttgtaaaaaaaaaaaattagtatttgaaagggaccttctggaaggtccctttcaaagtgtaaggaatgtttgcttcagtttctctttattcttactgcctggaatatacaagtcattgttagagccgtataagccatatttttgaccttgataataacgagagccggaagccaagaaaagtgaagctgaaagacaaaagtgcctgattccctggtgactttgtgaagctgtcgtaacagttctagaccgcccattcgcagactcactttatggagatggtaaactcccagtttgttttaactgccacagtcaagtctcagaatctataaaggtacattggaatcactttgtgaaaaaagttgtttctggatcactgtctcagctatttttaaaaaaatggcatccaacatattttcactggatggtcccatatacttctctttcatacctctttcctaagttccagaaccaaagacccaacttctcctaaacctttctccttggatgccccttggtcacttaaattcaacaagcaaaacctgaatgagtttccatactcaccgtaacatggtcttccttctatatacactgtttagttaacgatgccattgttgactaagtaaactatttaacctcaaaacctttaggaaattcttaattctttcttctttttcacccttaacacccaatggataattgcttctaaacatattttcctcagaattgttccttgtatagatacactcctttccattctcatcaatattgccctaagtaagttctcactgtttctctcttagactaattttttttttattatactttaagttctgggttacatgtgcagaacatgcagttttgttacatagatatacacgtgccctggtggtttgctgcacccatcaacccatcacctacattaggtattcctcctaatgtgatccctcccctagccccccaccccccgacaggccccagtgagtgatgttcccctccctgtgtccatgtgttctcattgttcaactcccacttacgagtgagaacatgtggtgttcggttttctgttcttgtgttagtttgctgagaatgatggtttccagcttcatccatgtcccagcaaaggacattaactcatccttttatgtggctgcatagtattccatggtgtatatgtgccacattttcttaatccagtctatcattgatggacatttgggttggttccaagtctttgctattgtgactagtgctgcaataaacatcttagactaatttttaaaagtcattcctaaataggtctcaatcctttagtcccttatctttctaatctatcactgctgtgtctaaaaaatgttaactttgaaatacatagatttactattgccatctcaaactaagaaattgttcattactctcaattgcctacagggtaaaattaaattataaatgatcctttcaaaacattcccagtttcctttacaagcttttgctctacttgcccacccacccttattccacaaaacacacaccaaaagtaccaaggaaagttgatttcagtcaaatcagactgcccaccatgtccataacattccatgtcttccctatctctgttttatttcagttgtcccctctatctcaaatcctttccctctcctcctcctacaagtacacatttgttttctacttattaaccaaggcccaaaacaggtttgcgccacttatgaagctttctcttgcctgctctgcacatcaaataaattatttcctcacttgctatacatgtacatttttacatgccaatgttgtatggtttattacagtgttctggaatcttttttgtatattcaggtacattttatgtttcttaattttttatgcatttcaatatcttaaggaaattatcatataatcatctttacatccctcagatgtactactatgccttgcacagtgaggggctcaattcatagtaatggatttgaatgaactacatatattttgtctctatacaggtaaaacatgcaacttcaagatgagtgcttgcaatatagatgtaagaatgattgtggaataattttaattaaatggtgtattataagaatatctctcaggttattttattttattaattcatcttctttatcctaaaccttcacacctcagacccagaacagaacatactgcccattcactttagaaatgcattccgttcacacctacttatttttaacccactatatttggtaaggcaatgtttcatgaacctaatcttgggatgccagctttatttagtaaactttgaatagtctgtagttttgaataccaaatttctgtaatttttagtgtctctctgctttggaatcatgcttgccatttttcaagagatcttatagaaaaatgatagattagatcttctgaatttaaagaataggaacaagacaagaactcagggtcactgagagattaaagtaagtgtgctttggcacacgtaaatgtaatgtatttagaaagctttctaggatctacctgcaaacagatggcagtaagatatgcaaaagggggcatgctctcctttttcagatttattttttttctaatggggaatagtgagtgagatgatgacagatagttttggatttgcaatgctcttcctcattttatataatgactcagcttttaaattgtaaatcatggattctaaatagctcctgcctaatttatctgtaatatatgtaaagttcatgaatttgaatcattataccaaacaggaatgaatttctatatatagaaaggaaattgtattttggaaggataattaacaccaatatattttaacagctatgcagaggctgaacttctaccacagattttttgaaagcttagcgtcatacaacatgaaactgtatatttgaaaaataaaatttatatgaaatttagaccttacaaagcacgattagtgtgtgaaaatgacaaaagtaaatggaagagtttatcctccaaataaacatacttttttacatatttaaggcagtataatgttaaatgagaaaatgaagactggatgtttaataagccaaaaggaatatacagtagttaaaaatatgtatacatattaatacatatgcatctatacacacatacatgctgtgtgtatctatataaatgtatatatacatacatgtatgcatatgtgtctatacacacgcatgttcctatttgcatggcttgtgactaaacaaaatgcatttttctctgaaaagtgacagggcactagtaatgcactcactgtgtttatgtgggatttttgataaaatttgaatatcaaagacactatttttccccctctaacaaccactggaataaaaagctagaatgcaataccatcttataatttccaaattattcactttcgacttgtgtttttcactttcatcacaaattcagtgttgtctctctgaacagaggaatcatagacctttgaaggtaaactcaactctgacatttactagtatgacattgggaaagctatataagaaaacagaacaaataaataagtgatccatctggcatgttattgtgaagattaacataaaatataggcaagacatagacagtcactatttgtttcctcccctctactttttttttttttttttttttttttttttgagatggagtcttgcattgtcgcccaggctggagtgcagtggcacgatctcggctaactgaaacttccacctcctgggttcaagtaattcttgtgcctcagactactgagtagctgagattacaggcatgcgccaccacacccagctaatttttgtatttttagtagagacagggtttcaccatgttggccaggttggtcttgaactcctgacctcaagtgatctggacaccaaagcgctgggattataggtctgaaacaccgcaactggctcctgcccactacttttgatggtgatcctttgtttgtgtttttgtaattacatcctctttcagaacattaactcattgagggactgtcgaatgccaggatagagaggccctatatgttacagacatataaatatactagtgtaattaaaaaaaattttctcagaaatataaattcccagaatatttatattgtttcatttaaacttaaatttataatcttagtccatgtccttctcaaagtcactgataactgaatccaatatagatatcaaatattattttattaccatttcttctccagagaaatgatctactgctattaaaagatgagtagaaaaggtatacattagttctaccatggtaatttatagcagcttaaaactcagggccaccaaagaatttatgaaaattcctctaaatctattaagttttatcatactccatttctgaaaatatatatggaaatgaaaaatctcaagacatgaacatctatgttataaaaagaaatagggggaaaatgaatatcaattaatagcagcgaagcaatcattttattaatttgcaattccacatgcatttattttagaaaaattataggattcattccggagttccatctgtacacattctgaagtcatgctctaaattaacatgcatttcttatccaattggcttataaaacttgatttactctttaatctctgaagtaaataaaaacaacatttttaacctttctttaagaaatctgctagtttaagatttcttgctagtttaaatacatgtacttttaataaaaactccaatttagtttttctaaactaattttacctaaaagatttggtcatgtaaacaagggtgtagttactctgtttcaagcatcttccacctgtgatcatgtaagtgctaggcagtactcacagctgacatgatgagctctcctcccaggttctggatctcagctttaacttgactgcagattttcagttggtgggagtagaacttaatctgttccaggtaggccaacaagtcctgtttacaagatggatctgggcactaaatatgaatcaaagataaaaatagatacagcagaataaataatagttagatcaaggtgagtaaatacagtattcacatggcaggtaccttataaagcagcaattttattttcatacaggaccaagtagcttctgatatgcttctaccatttacaatagttcattcattttgcaaccttagttacttcagcttagccaaaaggaacgttaaaataattatttttttgagatggagtctcgctctgttgcccaggctggagtgcagtggcaagatcttggctcactgcaacctctgcctcccgggttcaagtgattctcctgtctcagcctcccgggtagctgtgactacaggcatgcgccaccacacctggctaattttttgtatttttagtagagacagggtttcaccgtgttatctaggatggtcttgatctcctgacctcatgatctgcctgccttggcatcccacagtgctgggattacaggcgtgagccaccacacctggccaagaaacgttaaaataatttttagacataaaaaggtatataaaatagctgcctttaatttatgacaaaggttagaagccttcagattatatttttggtaaatctatagaaatatttaaaatgtaattatttctttcacctagaattactattagaaggctcctagaattactattagaatgctgcttgagactcatggtctctacactgtctgtcctgtgctactcaaatgggcataaacaacatggagcaacataatatgttctactactttcagcattcaatgtacttagctgttacagacaaaggaaattatttctaccttagataacagctgtgaatacaactgaagccaagaaacagacaggacacatgttttagaatattaaatttccttatgaaaaccagcctcctacatcattttatcttttcgaaggaacttcctggaggacagctttgagctttatcataccatggtaaatagctttggttaagatttaatctttgtgttctttctcctatgcaattataataaatttataaaaattccttctaatttaattccacttttagtaaatttttataagaacaaggaaatgtggacagtgatttatatgcaaagatcttcattgtagcattatgtataataacaaaatttggaaataacctaaatgtcccaaaataatggaaagactaaataagaatgaatatcaatataatgtagcattactcagtatcaagaaaatagagtttcaaaggatgtggaaaaatgtttttggaagttaaaaaaatcaatatgtaaatattgcaatcaaattctattaaaaattgtgtgtatttaaaacatgctgaatgccagacgcagtggctcatgcctataatcccagcaatttgggaagctgaaacaggaaaatcctttgagcctaggaatttgagaccagcctggggaacatagggagacactatctctacaaaaaataaaaataaattagccaggtgtggtcccagctattcaggaggctgaggtgggaggattgcctgagcccgagaagttaatgctgcagtgagccatgattgcaacactgcactccagcctggtcaacagagtgggaccttgtgtcaaaaaataaataaataaaaataaaaaataaaataataaaacctgctgagacagcctgagctgtccatccttcctaggcatagatcatggtgcatcaggactctctttgctccatacccaggcagatctccaggcactcagagtaccagcttgcctaaatcatcaggctgagcttccctaccctttctgtgcatagattgtggtgtagcaggccctctccactccacgcttgggcagatttccaggtattcaaagtacatgtttgctcagattgacagcctgagccaccccacactttctctgcagggatccaggtatgtagaggagcctctctgcttcatgcctaggcagatcacccagcatctggagtacccagtcccctggattaggagtttaggccaccccaaatctgtgtgtagagaatttgaggacaagaaagcttcccagctccatatctaggcacacctcttggtgtttggtacccactcactggattatgcttcagcaccggtgctcatgcctgcccttagggaattataggcaaacctgccagtctggacctgcccatcttgctcccaacacctctagggctgaggagggagctcagagcattttgcactacaagaataagcccattgcctgaggcaagaaagagcttctgctagtaaacaaggatgaagtatacacccatcggtattggtcatacacaccatctacaggcttgtaggtggaactgaaccgcccaatatgaaacctgctgacagaaaggtgtaggagtacacaagttaagccaaaagaccttacccagcattctctaaagtcacactccctagggaaaaatagatgggaaagggaaagggaaagaaaaaaaaatcaatagtattatagggaaagaaaagaaaaattatatctgcacaaatataattacaaaaatttgaagtatcaatgcttcaagatgagaaagaaccagtgtaagaattctagcaccatgaaaattcaaaatgtagtgataccatcaacataccatactagttctccagctatggtccccagcaaagtggaaacttggaaatgacagataaagaatttgaagtgtggattgcaaggaagctcaataagatccaagatgaggttgaaaattaacacaaagaaactttttaaagcaatccagagaatgaaggaagagataaacatctttaaaatatcaatcagagattctggaattaaaaaactaatttaatttcaaaacacaactggaagcttcaccaataaactggactaagtagaggaaagaatttcagatcttgaagaccagtcttttgaattgacccagtcggaaaaaaataaagaaaaagtaatttttataaaataaacaaagtctttgagagatatgggattatgtaaagtggccaaacctaaaaattagtgacattcctgagactgagaaaaagataacaacctagaaaaaatacttgaagtgataaatcaagaaaatgtttcaaattttgctagagaggtagacatctagatataagaaatccagagaacacttgagagatactatacaaaaaggaacgtcaccaaggcatataatcaccagactatccaaggtcaatactaaagaaaaaatctcaaaggcagctagagaaaaaggtcagaagacacacaaaggaaatcccaaaaggttaaaagcagacttctctacataaaccttatttataagccgagacagattggaggcctattttcagaattcttgaagcaaagaaatttcaacaaaaagttcatatcccaccaggctaagctttatcactgaaagagaaataaaaatattttccagacaaacaagcactaaaaaaattaattaccattaggccagttgtgtcagagacctttaagagaattctaaacatggggaaaatatagagctgatacctgctaccacaaaaacacaagtacagagcccacagatctatagcgcaatcaaaccatagaaaatataaagcaaccagcttacaacttcatgataggatcaaaatcttgcatattaatattatccttgaatgtgaatagcctaaaccccccacttaaaaggcacagagtggcaagttggatagaataacaacatccattcatctgctgttttcaagatacccatctcacacataatggcatcaataagctcaaagtaaagggttgaagaaatatctatcttgcagattaaactacaacaaaaaagaggagcggctattatattagataaaatatatgtactttaaaatatatttaaaatataatatatataacatattaggtaaaatatatgtattttaaaatatattaaaatataatatataatagataaaaaagactttaaaccaacaacagtaataaaggacaaagaagggtattacatgatgataaagggttgaattcaacaaaaagtcttaactatcctaaatatgtatgtacccaacactgaagcatctgaattcataaaacaagtacttctagatctacaaaaaggcttagatagccacacgataatgttgaggaacttcaacaactcactaaaagtgttagacatgtgaaatgttagtcaattaaacctctctttttttttttttaataaattagctagtctcagtatcttcatagcaatgtgaaaatggactaataaatttacttttgggtaaacaatgaaattaaggcagtaaccaaaaaattctttgaaataaataaaaataatagacacaacatataaaaatctctaggatgtagcaaaagtgctgttaagaggaaagtttatagcagtaaactcctacctcaaaaagttagaaagatctcaaattaatgatttcacatcatgcctagaggagcaagaaaaacaagaataaaccaacccaaaagttagcagaggaaaagaaaaaattaaaattagatggaactgaaagaatttgagacctaaaaattcataggaagaatcaatgaagaccaaagttgtgttttttttttttttgaaaaaataaacaggatcggtagactgctagctagattaacaaagaaaaaaagagagaggattcaaataagcacagtcagaagttataaaagtgacattgcaaccaatatcatagaaatacaaaagagcctcagaaactattgggaacacatctgtgcatacaaactagaaaatctagaggaaaagataaatttctgaaacacacaatcctccaagaatgaattagaaagaaactgaaaccctgaacagaccaaaatcgagttcctaaattgaatcagtaataaaacacccaccaccaacaacaacaaaaagagccccagccaaattctaccaaacatacatagaagagctgataccaatcctactgaaactattccaaaaaatggagaaggagagactcctctttagctcattcaacaaaaccagcatcatcctgataggaaaacctggtaaagatacaatgaaaaaaatctctgataccaatatctctgataaacatagatgcaaaaatcctcaacaaaatattggcaaactgaatttagtggcacatcaaaaagttaattcactatgatcaagtagacttaattcttggaatgtaaggttggtttaatatagacaaatcaataaatatgactcaccatataaacagaattaataacaaaaatcatatgattatttcaacagatgtgggaaaagcttttgataaaatacaacatcccttcatgataaaaaccttcaagaaactatgcatcaaaggaacatatctgaaaataataagagccatctaagagaaaccacagccaacattatacttgaatggacaaaagctgaaaccaatctctacttgaatgggctaaagctgaaaccaatctccttgaaaactgttacaaggatgcccactctcacctctcttattcaacatagtactgaaagtcccagccacagcaatcaggcaaaataaataagtaaaaggtatccatctagacaaataaaaagtcaacctatatttctttgctgttgatatgattttatacccagaaaacataaaatactttactaaaaggctcctggaactgagacacgacttcagtaattttttaggatacaaaatcattgtataaaaatcaatagcatttctatacaccaataacattcaagttgagaaccaaatcaagaactcaactccatttacaatagctgcaaataaataaataaataaaacacctaggcatgcatctaaccaaggaagtgaaagatctctacaaggagaactatacaacactgctgaaagaaatcatagatgacacaaacaaatggaaaaatcatttcaatttcatcaactggaagaatgaatatcgttaaaatggccatgctgctcaaagcaatctacagattcaatgctattcctatcaagcaaccaacgtcatttttcacagaactagaaaaagaactattctaaaattcatatgaaaccaagaaatatcttgaatagacaagcaatcctaagggggaaaaaaaaaaaaaaaaaagaagccagaggcatcatattacttgacttcaaactacactataaggctacagtaacacacacagcatgatactggcacaaaaacagatacacaggctgatgggacagaatagagaacacagaaataaagctgcacaactaaaaccatctgatctttgacaaagttgacaaaaataagcagtgactccctattcagtatctggtgctgtgacagctggctagccaaaggcagaagaattaaactggacccctatttttcatcatctagaaaaattaactcaacatgaattaaagatttaaatataagacctccacaataagaatccttgaagaaaaacctaggcaacatcattctggacatcagtcttgggaaagacattataactaaattctcaaaagcaattgcaacagaaacaaaaattgacaagtggaatctctaattaaagagcttctgcatagcaacaaactatcaacagagtacatagacaacccacacaatggaagaaaatatttgcaaactatgaatctaacatagttttactatccaggatctataaggaacttaaacaactgagcaagcaaaaagcaatcccattaaaaatgggtaaatggtacgagttaggtcattcttgaattgctacaaaaaaatacttcagactgggtaatttataaagaaaagaagtttaattggctcgtggttctgcaggatatacaagcattgcgttggcatccacttggctttggggtgggggctcagggaatatttactcacagtaggagatgaagtgggaacaggtgcacgacgtggggagaacaggagcaagagggaagtgggaggtgccacacacttttaaatgaccagatcttctgataatgcactatcctgaggacagctcatcatgaggaatctgcccctattacccaaacacctcccaccaggccccacctccaacattggggattgcatttcaacatgagatttgggaaggacaaatgccaaaaccacatcaaaacatgaatggacacttctcaaaagaagacatacaagtggccaaccaatgtgaaaaaatgctcaacatcatgaataatcatagaaatgcaaatcaaaccaaaataagatactatctcacaccagtcagaatggctattattaaaaagtcaaatacaacagatgctggtgaggctgtggagaaaagggaacactttataaactattggtggggatgtaaattagttcagccactgtagaaggcagtttggagatttctcaaagaacttaaaacataactaacatttgactcactcatcccgttactatgtacatattcaaaagaaaataaattgttctacccaaaaagacacttgcattcatatgttcattgcagcactattcacaaagcaaggacacggaatcaacctaggtatccaccaatggtggattgaataaataaaatggggtacatatacaccatggaataacagccataaaaaggaatgaatgaaattatgtctcttgcagcaatgtggatgcagctggaggccattatcccaagtgaattaatgcaggaacaaaaactcaaataccatatgttcttacatacaagtaggaggtaaagaatgggtaatgatggacataaagatggccacaatagaaactgaggattactagacaggggagggaggaagggagtaaaggcttgagaaactaattattgggtactatgctcactacctgggtgattgcatcaattgtacttcaaacctcagtatcatgcaatatacccactgaatctaaataaaagttgaaattattttttagatgcattaaagataaatacattctggactctgggttaaaaaaaattaaaagatgctgggaaagaaatatatgacaatcatcaataaatgtgatataatcaatacttttattttattcaaattttgtatatcttaaatatatatttcttctataactataaaatgttattttttaaagcttttattctaatgacctaaactgcaaattaaaaagtaggatgaacaaccagaaaacctttcatgcatttctgcttttattcagtaattaataacttaagctggagtgtttttggaaaatttgtgaggtacttatcgtcttatattttttaaataggctgtgtagctccagagtgtgtgcacaagatgagaacacattaccctgagtcaaagtcgataataatcaacaaaggtagcaaagaattcaactcttctgcagaaatactatcaatctgcaagataggcatggacatatgcatgaatagatacaggatagccagacagagacacaatcagacaagaatatagaaattaagggtgtttctcaagttttcagtaagcaaatgagggttatccctcaaatctcctcaaaaggattatattgtagctaattaagaagaagattggaaaggagaaagatatggagaaagaaaagaaaaagaaagagggaaaggaagaagaggagaaggcagagacagaggaggaagaacaatagttaattttcatttagctcttactatgtgccacatgctatggaaactaatttaggcatatcttctcactcaatcattaaaactgtaagacgcaaatattttccccaatttacagatgtgaaattacctaaaacgatgaaaaacaagtcatctctttgttttctcttgacaggcagctgatctttattaggtacttcgtctgtgccaggtactatgccaaggcctttacatgcataactttagtactcaaagcaccattttaattagatctattattttcattttgtagatttgcaaagtaagtttcagagagagtaaatgatttgaatttagttttctctgtttcattcacatgcatacacaataatctcttctatagggcattctttcaaatcattttttgttattattgctttcactgagtaactttcttatctattcttcattcttaagtatggacacaatgataatacctgacatgtaaagtgttttatctgtcatctataattctagatgttttgtctctactaattgttttaataatcacacaacacccacagtttcatgaggtaagtggaatcattatcctcatttagtgaaggagaatattgacaaacagagaggttaactcacttgccaataaatggtattagtggtagagctcgtgttcaaacataatctggctacacctccttacctccatgttctaggaacagtatcagtcttcttgccaattttatcttttttgtaaatattaaattgtcattctgatttgtaagttggtttcttattgataatcttatttgtcaattataaactcgattaatgtggatttgttccttgaagaccagcaccactatacaactctgataaaatcaaactgtcaaactagtaatcagattcttgaccaataaccaattgcaatcactcaagtttaagcaaaacatgctgtctctatcaagagactcttccaaggccacagtagaaaagcctataattccattaaggaaagaatgagtcaaatgagtagaaagtgtgaaaatgatcttttgaaattcaaagttgcttgacctaaatttacctttcattttcagaactgatgggaatatcttggttataacagaagcagtcagttttataaccaaagtaaaacaaaatactatgtggtaaattcttatacttataaaagttattaaagccttctttcccattgacatgcagaaagcctttctgagtcagttttgctcacttagaagcagaatcaggagaatgcctcattcctactttaagaatattctactatttttcaaatctcctttgggccacttttatgtattcaggtcttttcccattttttaatcaggttacttggattttttttctattgagttctgcatgtttcttatacactctagatattaattccttatcagatctatggtttgcaaatattttctttcaaaccataggttgtcttttaattttgttgattattacattgtatatcttaagtccttaaatatgtacaatttttacaaaaaaaattaaatttaaaaacatcgaacaatgcttttcccaccttttaaatttttacgtgaaagtgacagaaaaacttcggtctctaggttggtagaacattcttgccctttactgttgtttctcaagtaacatttgctttaaaataacttttaaaagaatactattagggacttttccagaacatctacttagttccttaatgcatgatttttttttaaatctaagttttataatcacagggactcacaacatgtaagcagatggcatttcagcctatgtggttttctcactttaagccagttttcacgtttctaccaagacgcttggagccaatatggaatacatcatttagtaatgaggaaaaatgtaaaaaaaattcattacgttttagtttaaatttcaggggtgaattagcaaaacgaacacttttcaagacttttattccataatcttagtatttttttgctcatattggagcctaaactttaagaaatttaaaatgacttttgcagccaggtgcggtggctcacgcctataatcccagcattttgggaggctgaggcaggcagatgacctgaggtcaggagttcgagaccagcctggtcaacatggtgaaacctcatctctactcaaaatatgaaatattagccgggcatggtgactcgtacctatagtcccagctacttgggtggctgagacacgagaatcgcttgaacctgggaggcggaggtgcagtgagctgacatcgtgccactacactccagcctgggtgacagagagactccgtctcaaaaattaaaaaaataataaataaataaataaataaataaaacgaattttgcaattacagacaatagcctacattttgctaagctggaaaagtttgttaatgaaaagtactaggtgtcactgtgaatttcaaaaataggaatttaaagcgatcagtggtagcaaaagcacttggtgttcatgacttttcccatcccacagggctcatttcttcacctgtaatgccttgtttcatcttgctcaggatcacagatcatcaatgatctcatcttttcctctacttttaatgcctttttttttctgattcctgactctatcaagtccctcaaagcaaaaccctgacttctataatcccatgtctccttttttgtttatgaatatgcctactaaaatgtttcaatgcagattcctcctttccttatcattctaagaactgttttcaactcctccagtccgcagaattttatcttactgagatcactaatggacttataattgccgcattcattatatatgttgcagttcctcccttatatcacctctctggagcttttagatctttattgattttcataaatattaattctcatgaatgtttcctcttagattttctcctagttttacaccagccttcccagactgtattgtaagcatttttttttttccttgcacgtgttgttgttctcagcttttgttcctgagcaatttttttttttttaactttcattctcttcttggacaacagtagacagtgctctggcttcatctgtcacttacacaacacaaactacaaaattctaacatccagctctgtcatcaggcgatccatgtaactactgtgttagtccatgccatttcagcatctcatcaacatttcacacttaacacatttatctctcagctatttcactatcttgcctactcacctattcaactattttttctctttgtattaactatctcaatgaagaatgccttgttcctcttttccatctcttaaatctggtcagccattagtttgtgcttattctacacctagaaacctcaatatattttaagtatttttttctttgctatgcctatgacagctgctgtttagcaaattcaggtttctgaaacacagaacagagaaggtacctatagaagtatgattaaaaatacactggaactctgttataatgtcagtggtagaggataacattgtctcatatggtatgttcaagactggacatgttgatttatgagagttataattgggaaagtatggtgcatggcatatctcaatgaataaaggttgtttttaccagaagttatatatgctgttaaaatcctgtcatattttgtccatatttaggctgaaattgtcttgagtttaagaattgtttcaaattcctttttattttcaacttggtttgcacatacagctattgagaaagtgacatgtactttgaacacaatacaaattaaagacaagatgttttccttattcaacaaagctcctttactttagtagatgtaaagttatgactcaagctacttttcagctttatgttacttccatgagagattctcagaagaaatgagtgtcctatgtaatagaccataactcaaaagtgtcaccctctccctcatgcctgaaatttgtcattcaaagaattacttcgactgaaacaaactcatacaagtgcattatcctgtacataaaataaggatgtggaaaagatggtggaaaggtaactcagacaaattctggttatttggaatttttgattaaagatagccagccaactacaagaagaaactttgctcatccttcctcttctccacttatacaagatagctccttccacctagaccctaaaacactttattttttggttacatagttttgtaactatacatgaagtgaacctgaatagataatcaccctaggagcatttaaaacactgtttcagtgaaaaaatgtcagacattacataaaggggaaaagagtaaagcagcatctcttagaacaggagattcactattacttgaaagacgcaaatagatcaaatatttcagtatacatttagtcctatttaaatcttgagaactttctgtgcatttatttttataaagtaggagttcattaatctggagaactaatctaggcatcaacatttctgccagagaagaaaataaataacaaagatctgagcagaataaaatgaaattgaaaccaaccaacacacaaaatacaaaaaataaatgaaatataaagctggttctttgaaaaaataaataaaatcgatagatcattagtgagattaacgaagaaaagaagacagaaggtccagataaattaaattagaacgaaatgggagatattactactgataccacagaaatacaaaagattattcaaggctactatgaacacctttacatacataaactagaaaacctagaggagatgaataaattcctggaaatatataaccctcttagattaaaccaggaagacatagaaactctgaacaggtcaataatatgcagcgagattgaaacggtaatttaaaaattgccaacaacaacaacaaaaaagtccaggaccagacaaattcacagctgaattctatcagatattcaaagaggaattgataccaatccgattgacattattccacaggatagagaaagaggaaatcctccttaaatcattttatgaagccagtataactctagtaacaaaaccagggaaggacataacaaaaaaaaaaaagaaaagaaaactatagacaaatatccctaatgaaaatagatgcaaaaatccccaacaaaattctagctaactaaattcaacagcatatgtaaaaaaaaataaactgccataatcacgtggggttcataccagggatgaagggattattcaacatctgcaagtcaataaatgtgacacaccacataaaaaaattttaaaaatattacatgatcatctcaatagacacagaaaaagcatttgacaaaatccagcatccctttatgattaaagccctcagcaaaatcagcatagaaatgacataccttaaggtaataaaagccatctatgacaaacccacagccaatattatactgaacggggaaaagttgaaagcatttcacctgataactgggacaagacaaggatgaccactttcaccgtttgtattcaacaggactctggaagtcctagccattgcaatcagacaagagaaagaaatcaagggcatccaaatcggtaaagaggaagtcaaactgttgctgtttgctgatgatatgatcatatatccagaaaaccctaaagactcatccaagaatctcctagaactggtaaattaattcagcaaagtttcaggataaaacattaatgcattcaaatcagtggctctgctatataccaacagtgaccaagctgagaattaaatcaagaactcaaccgtttttttacaaaatctgcaaaaagaaaaataaaatacttaggaatatacctaaccaaggaggtgaaagacttctacaaggaaaaccacaaaacactgctgaaagaaataacaggcgacagaaacaaatggaaacactcccatgttcatggatgagtagaatcaatattgtaaaaatgaccagacttccaaaagcattccacgaattcaatgcaattcccatcaaaatgccaccatcattgtttacagagttagaaaaaacaatcctaagattcatatagaaccaaaaaagagcccgtatagccaaatcaatactaagcaaaaagaagaaatctggaggcatcacattacttgacttcaaactatattataaggccatagtcaccaaaacagcatagtactggtataaaaataggcacacagaccaatggaacagaatagagaacccagaaataaagccaaatgcttacagtgaaatgatctttgcaaagtaaacaaaaacattaagtgaagaaaggacaccctatatgacaaatggtgctgggataattggctagccagatgtagaagaatgaaactgggttctcatctctcaccctataaaaaaatcaactcaaggtgaatgaaagaattaaatctaagacctaaaaccataaaaattctagaagataatatctgaaaaacccttctagacactggtttcggcaaagactctgtgaccaagaacccaacagcaaatgcaacaaaaacaaggataaatagatggtacttaattaaaatggaaagcttctgcacagaaaaagaaataatcagcagagttaatagaaaacccaccgaatgggagaaagatcatcacaatctacacatctgacaaaagactcatattcagaatctccaaataactcaaacaaatcagcaagaaaaaaaatcccatcaaaaagtgggctaaggacatgaatagacgattctcaaaaaaaaaaagatatacaaatggccaacaagcatatgaaaaaaatgttcaactcactaattatcggggaaatgcaaatcaaaaccacaacgagataccaccttactcttgtaagaatggccatgatcagaaaaaacaaaacaacaaaaaaaggtgttggcatggatacagtgaaaagggaacacctttacactgttattgggaatgtaaactagtacaaccagtatggaaaatagtgtggagattccttaaagaactgaaagtagaactatcatctgatctagtaaccccactactagatatctacccagaggaaaaaaaggcattatacgaaaaagatacttgcacacacgtttatagcagcacaatttgcaattgcataaatatggaatcagcccaaatgcccatcaatcaatgaatgataaagaaaatgttatatatacatatatatatataaatgtggtatatatgtgtgtgtgtatgtatatatatatgtgtgtgtgtgtgtgtatatatatatattcatgtaaccaaacaccatctgctccccaaaaacctcttgaaaaaaaaaattaaaaaatttctgctggaaataaatttcagataggtaatacctttaaaatacgcatattgtcacaaggtgtatctaggaattatatccttaggagttgtgtaatcatgatataatgaaggctccagaagcttctcagtagtatagtttcattgaaataatttttttgcctcttataatatcaacatgaaacaattcaaatgaggccagcctccaagaatattttgtaaaatattaatacaaattatacttgtaggttgttttgttcataatggagtgcattttgtgtgatttggtttatatttctttactttggtttttaaacatcatcttttcttgaattagaattagctgccaatgtatttaacactaaaagttcgttttaattttgttcagttacaattaggtgggaatgtccagttattagccttaatatctttgctttggcaaaattacaaggaggaagtaattaggctgcttaaagatcaccgagggatcagaaagtctaacactgttctctcctggtgcaaaacacttttagcagatgctaattttattttggctcctattgtctccttcctatctaggttatactgcttctataactatttgaaatctttttgtgcattatccttaccttatgagatgttactttatctaatttagaatatctgctaatatgattaattacaatgtagagtacagaaatagaaaaaaatatgtactgaaagcctgaaatcttggattcatattttacttctccaacttattctgtttaattcacaagcaaaatttttaagaattgttataggtaagaatagctataacaatcttgttttatacaaggatactgtctaaaggagacaaaatttgtgctaaaattctacaagacttaaatatatctttgatggcatacttaagccttttttgagaccgccattttgagacaattctgaagtctaaaaaatgttgaatgactgggaaaattaaacagaaggttttagttcttctctttctaactagctaatgccaatgccagagtagtgaattgtgtgtggcatacacacaataaatattctctcaaggaagcaatgaaggaaggaaaagtgaaaaataaaaatgaaaaggccaagcaagcagaatgagaagcatcaactaatctaattgtttcattctttctacatgtgaactttaactctgaaactttacagaatgtaactaaattggtctaataatatatgtaatagatgatatatatataaacatgcatttaaataatttaaatatatatataatttcaaatctaatgttagttggaatggatattactgtttgaccttctgacacaccagcaaaaactaaagctagaatgtattatttttgaaatattaaattgatcaaaagagaaagcaaccaatgttccagcagatttttttcataatatacatagacactgaaaatcacattgcttacattactcaatttattccataatcaatttcagatattattttctgcctaaaatgtcttaatctatccaataataatgtcagaagcacattcaaagacaacctccctagatggtcactgtaataactgagtcagtttcttcattctcagttttgattacttagaactatatttcttcagaacaaaagtaattcatctgaaactattttatgtatgaaatggaaaaggccaaaaagagtcatctataattctttattagtcagtgactacttctctaagcttctcttaaaatgtcaaagctatacagaagtaagatgatacttttgctttctcccataccatttgaataatgctaaaaacaatgacataatttgataaagccatgttatagaagtacctacttcaaggcaacctgatccaattaaagaagattatcaatataagaaaaaaaaccttcaatgtgacacaattatgtcaactttgaaaactgggtgtttcaaaataaacagaaaaaaatgggaggaagcattcagtatttaaaaagttattaatacatgtaaatatgtgtcatgtactatgtttcacttatttcactaagatttagtgtctctcataaaagtgaatgcaataagattctaaaataaagaaaactgtgggcatatataggcttcagtcacataatcaaactcagaaattttgacttatttaggatatagtttgttttagctgtaaatactaaatactaaaaaaaaggattaataaaattttataataattaaagtaacacggaaaagacatatgttctttattattaggaatgttattaaacagtttattataattagtctttatttgtttcttattccttatatccacaaatacaatatttaataggagagagttcttcattttccaagagagtataaacatagtgaacaatagtaatcattataaaaagaagcccaaaaacctttccctaatactatttaagcaagaaataatatgaaacagttgcaaaaatcctcatttttttccaaaaggaaataaatatgtactatgaagttgaacataatataaaagccatgaaataatattatacctcagtctgaaatattaattgaatatctcaacacattaatgaaagcaacagatttttcagttaaagtgtaaagtatttctaaggatgcagcagctgcttagaaatactgaaataaacatgagaaatctaaaaaaaggaaactaaaatgtttatgaacaccagtctctatattaattatgtattttatgcattttatatctttagtattatctttagtattctactaaatactacttttctttgaattttaaatattatattagaatatattgttgacacagaaaacctaacattataacattttaaaatgtattaatttttgaagagcaaaaataaggaaacaattgacagactttcctgtaagatctgaaacaagacaaggctgcctactgtcaccatttttattcaacatagaactgaatggcctagccagaaccattagctaagagaaagaaatatagagtatccaaattggaaaggaggaagtctaattgtcctagtttatagataacatggtcttatattaagaaaaacctttctttgtgttacaaacaatccagttataacttttagttatttttaaacatataataaattacttttggctatagttgccctgttttgctatcaaatactagatcttatttattctatctaactatatttctgtactcattaaatatattcttatcccatttgtctttactgattgattcatgaaaatgtcaaaagtgtaataaaacattgctattactaattaaactactaagtgaaaattaaaatttctttttgtttattttgtctctggatagttgactctgagtgtgaatcctgtaccttatttaccctgttgtgattattacacattgtatgcctgtatcaaaatatttcctgtaccccatacatatatagactaccatgtgctcacaaaaatgaaaaataaaaatatatatacaaaaaaaagaaaaacctaaaggctctaccaaaaaaaaaaaactcttagatttgataaaaaaattcaataaagttgaaggatatcaaatcaacctgcaaaaatcaacagcatttttacacacaaatagtgaacaatctaaaaaagaaatcaggcaagcaatcctatttctcatagctacaaaaaacaaaacacctagaaatcaatataactaaagaggtgaaaaatccctactattaaactataaaatattgataaaagaaattgaagaggagacaaaaaaagatatcctctgttcatgtatggaaagaattaatattgttaaaatgtccatactgcccagagcaatatacagattcagtgtaacccatagaaaaataccaatgacattttttacatagatagaaaaaaaaaatcctaaaatttacatagaaccacaaaagaccctgaatagccaaagcaatcctgagaaaaacagcaaagctggaaacatcacacgacctggcttcaaaatatgttacaaagatatagtaactaaaactgcatggtactggcattaaaaaaaaaaaccacatagaccactggaacagaatggagaacccaaaaataaattcacatatttatagccaactgattttgaacaagtgtcaagaacacacattgagaaaaggatagtcaataaacagtagtgggaaaattggatatctattgcagaaaaatgaaactaggcccctacctttcaccatatggaaaaatccaatcaaaataaaggcctagcataaaatccaaaactataaaactagtagaagaaaacacggggcttcaggacattgattttggcaaagatttgatggctaacacctcaaaagcacaggcaacaaaagcaaaaataaacacatgggattatatcaaactaaaaaggttttgcacagcaaagaaaacaattaacagagtgacaagacaacctacagaatgatagaagatattttcatactatttgacaagggattaaaatacagaatacataagacatatcaacagaagaataaaacaaatttaaaaatgggcaaatgatctgaatagtcatctctcaaaagaagacatacaaatggccaacaggtatatgaaaaaatgttccacatcattaattgacaggaaaatgcaaatcaaaagcacaataagatatcatcttaccccaattaaaattgctataattgaaagaacaaaaaataaattctgtcaagaatgtagagaaaaggggactcataccctgttggtaggaatgtaaattagtacagccattatggaaaataggagttttctttaaaaactactactaataaactaataatagaactaccatatgatccagcaatccattactgggtatttatttaaagaaaaggaagtcagtatgtcaaagagatagctgcactcctatgcttactgcagcactgttcacaacctgtcaatcagttagttagaatcaatctaactgtccaccaatgaatggatggataaacaaaatgtggtatacaagcacaatggaatattcaggcacaaagaaaaatgaaatcctgtcatttgtggcaacatgaccaagactggaggacattatgttaagtgaaataagtcaggtacagaaagacaagtaccacatattctcatatgtgagagttttaaaagttgatgacacagaattaatgaatagaataatggttatcaggggcagggaagagtagcggagaggggaagataaaaataagttggttaaaggtacaaaaatacagttatataggaggaataaattgtagtcttctgtaacataggctgactatagttaataatttattgtgtatttaaaaatagctatatgagaagattttgaatgtgttcaaaacaaagaaatgatagatgtttgaggaatagtatatgctcattacctaatttgatcaatacacagtgtatacatgtatagaaatatatgtactctacaaaggcaattattatatgtcaattaaaaataaaacataatgaaaataaatgttaaaaatacacaaccaaaaaagaaagaaagaaatataatgtatcaacaacaacaaaactcggttttgtaattacaattgattaaaattaattgagtatatttgatgctgaagagctgatactagaaataatttgagtatgttttaagctaaaaatatctgccctaagaaataattaagcttccttataatcgtccattacctagtgtattaatagagctattagaaattcaattataatttagaaaaaatggttgaagagagtaaaaatttaactttgcctaaatcaatgttctaatggcaaagagcaattagcatgaacttttatgatgtccacttgtaagtaactcacctgattagcaatctgccgagcaaggacatccatccttgatcctgattctgatatcattttcgctgcatagatcacatcagttgtatgctttagtggtcctttgcccctggaaaaaaatttatatatgttagctgtggtgttcatgagaaaatatatgttagctacgatggttcatgaaaaaatgtattaatctatgcgtccatccatccgcatatgtaaaatattcgcatcccaaagaacggctattgtttttgtgattgtttgttttgagactgagtctcactctgtcgccaagcttgagtgcagtggtgcagtctcggctcactgcaacctccgcttctcgggttcaagcgattctccagtcttagccccccgaagagctgggactgcaggcgcgcgccaccatgcccggctaatttttgtatttttagtagagatggggtttcaccatgttggccaggatggtcacgatttattgacctcgtgatccacccgcctcggcctcccaaagtgctgggattacaggcgtgagccgccgtgccctgccagctgttggttttaatattttgattttgaaaagagcacaatcagactccagtattattattattattttttaatgccagcctattgtgttaagtcaagaaatactgcagagaagatgaagacctttttgatcttcattcccaggtgtttattatagtaaaactcagcctagagatacccttcatagacctagatacctcaaggcaaaggtattttcctgattttagagagaatcataatattttggatattatatgtatctaacgatttattttttatcagcaggcctacttttagtatttcacattttttctgttgctatattttagttactttaaaaaaatttattgatggtaaaattcattttttatggggtacatgtattattttgctatttgtacatacatagaatgtgtaatgattaagtaatgttatttagggtatctgtcacgtcagtcaagtattatttctatttgttgaaaatatttgaagtcttctcttctagctattttgaaatattcaatacattgtttttaactatagtcatcctactcaactattgaatatttgaattgttctttctaactgtatgtttgctcccattaaccaacctctcttatccccccaatccccaacaaacaccatgccaagcctcagataactatgattctactttccacctccatgagagcaaagtttttagctctcacatatggaggagaaagtgatatttgtctaacttatttcacttagcataacatcctccaggctcatccaagttgctgtaaatgttaggatttaattcttttttaatggctgtgtttcattttgtgtgtagtgtgtgtgtgtgtgtgtgtatacacacacacacaccacattttatttatccatttatccaacacttaggttgatttcacatctttgctattgtgaataatactacaataaaaataggggtgcaggtatccttttgatatgctgatttccttttctttggataaatacttaggagtgagattgctagatcatacgttagtactacttttaattttttgagaaatatccatattgttttccataatggctgtactagtttacattctcatcaacagtgtataagagttcccttttcaacatacctttgccagcatctgtttttttttttttccttttaataatagtcattctaactggggtaaaatgatatattattgtagttttggtttgagttttcaagctaattagtgatgttgagcatgttttcatatacctattggtcatttgtcttcttttgagaaatgtctgttcatgtcctttgcccgctttttgatgggattattattattttctcctgttgagttgttttagttccatgtattctctgaactttaggcccttattagagaaacagtttgcaaatatttttaaatattaaatatttaaataatttaaatattaaatattttctactatttaacaggctctttactctgttgattatttcttttgatgtgcagaagctttttagtttaatatagtcccatttgcctatttttatcttgcctgtgcttttgaagtcttagccataaaatcttcgtctagaccaatgacctgaagcatttccccaatgttttcttcaagcagttttataattttggatcttacatttaggttttagctgatcttgatttgatttttgtatatggtgagagataggtggctagtttcattcttctgagtatgattatcctgttttcccagcaccatttattgaagagccatcctttccccagtgcctgttcttcccacctttgtcgaaaaccagttggttataaatgtgtggatttatttctgggttctttattggttcatgtgtctatttttacgctcatacaatgcttttttggttactacagccttataatatgtcttgaagccaggtagtatgatgtgttgtgtcctttttcctgttcttttcctcagtattgctttggctatttggggacttttgtggttctattaatatgtaacatttaggattgtttcttctgtttctgtgaagaatgtcactgatattttgatataattccactgaaaatgtagatttcttttggtagtatggatattttgacaatattaattcttctgatctatgggcatgaaatatattttttattttttgtgtcttgttcaatttcttccaccagtgttttatagttttgtttgtagaggttggttcttgtttggttaaaattattcctaggctttttttttgtagctattttaaatgggattgcctcttgatttcttttgcacatttttcagactggtgtataaaatgctattgatttttgtatgttgatttagtactctgcaactttccttaatttttcaaatctaagagtgttttggtggagtctttaggtttttcttaatataagataatttcattgcaaagaaggacaatttggcctcccattttccaatttggatgacttttctttctttttcctgattgctctggctgataaccttcagtactagaatcctgaaggggagttataaaagtgggcatcctcatcttgttccggatcttgatagaaaggctttcagctttgttccaatcagtatgatgttagctgtgagtttgtaatatgtggcctttattatgttggggtatattccttctaaatctactttcttgagagttttcatcatgaaaagatcttgaattttatcagatgcttttactgagcctattgagatgatcacattttttaatctttcattcttttgatatgatgtatcacgtttattgatttgtgtatgttgaatcatccttgcatcccaaggataaatcccacttgattaacatgtgttatctttttggtgtgctgtttgattaattttgctagtattttgttgagggtttttgtgtctcattcatcatggatattgacctgtagttttctttctttcttgtgttcttgtctggttttggtatgagggtaatactgcctcataaaataaaatagggagaattccctcctcttcagttttgtggaatgccttgaggaaaatcaatgttagttattctttgtaagtttggtagaattcagcaataaaggaaccaattctgggcttctctttttcgggagtctttttgttactgattcaatctactgtgcattattgttctgttcagattttctattttttccacacttgatcttcgtaggttttgtgattccaggaatttattcatttcccctatgtcttccagtttgtaaatgttaactgttaataatagtgtctgatgaccttttgtatttctgtgatgtcaattgtaatgcctccttttacatttataattttgtttatttgggtattctctcttttcttggttagtcttgctagcaggttatttaattttttatcttttcacaaaaccaatttgttgctttgttgatctttcgtatttttttagtctctgtatcatttagttctgttcttatctttattacttattttcttctactaattctggatttagcttgttcttgcttttctaattccttgatgtgcatcattagattgtttatttgaaaactttctagttttttatagtaggaatttattgctatgaacttccctcttagcactgcttttgctctatcctataggttttggtatattgtgtttttattttctttctttttcagaaacttgtttgatttcctacttaatttcttcattgacttgatgcttgtctaggagattgttgtttaatttctacgtatttgtacagcttccaaaattcctctttttactcatttctagttttatttgattgtggcataggaggacacttggtatgctattaacttttaaaaaatttgttaagatttgttttgttgcctgacatatggtcaatcctacaggatgtctatgtggttatgggaaaaatgtatattctacaactgttcaataaaatgttctgtagattggcctcttaggccaatgtggtctaaagtgcagtttaaatacaatgtttctttttaaattttctgtctagatgatctttctaatgctaagagttgagtgttgaagtctccaactattattgcattggagtacatctctcccttttgatgtaataatatttgcttcatatatctggatgatttcatattgggtacatatgtatttataatttttatattctcttgctggatttgtccttttatctttaatataatgaccttcattgtctcttttttactgtttttgacttaaaaatgtttttatcagatataagtagagatacttatgctcacttttggtttctgtttgcaccaaatatctttttcaatcctttactttcattctatatgtctttacaagtgaagtgagtttcttagaggcagcagatagttgggtcatgtggtccttgcttttggttttggtttttgttttcaaatccattcagccagtctttctctctatatatattttttagatggagtcttgctctgttgcctgggctgcagtacagtggcacaatctcagctcactgcaacctccacctcctgggttcagcctattctcctgcctcagcctcctgagtagctgggattacaggcatgtgccaccatgcctggttcattttcgtatttttagcagagacagggtttcaccatgttggccagactggtcttgaactcctgacctcgcgatctgcccacctcagcctcccaaagtgctgagattaaaggtctgagtcaccaagctatatcttttaagagcaaaatttaatccatttaccttcaaagttattatttatgtgtgaggatttatttctgtcattttgtaaattgttttctggatgttttgtgtatacttcgttcctttctttcttattgtttatcattatggtttggtgtttttctgtagttgtaccatttgagtagtttctacatttgtatgtttaccagtaagttttatactttcctgtgttttcatgataatagatatcatctttgcactttcagatataagaaccctttaaaggagtcacgaaaacaaaggaaagtaataaatttcctcagtttttgcttatctgggaaagagtttatttcttttttatagctgaaggatcaattttgctgggtatagtgttctggattgacattttttttttttggtttttctcctcccagctctctgaatgtatcatctcattctctcctgatctgtaatttttctgctgaaaaatctgctgttagttttaataaggtttcctttatatttgacttaacatcattctcttcctgtctttagaaatcctttctttgtatttgactttcaacaatttgactataacttgcctttaacaagaactttttgagttgaatctatttggggctctttaagctttctgaatctggatgttcatatctctcctaagacttttaagtttccaggcatcattttactaaatagattttctatggctttggaattctcttcaacttctggactatccagaatttgaaactttggttactttatggagccccatttgttacacaggatttgtacaatctttttttattatttattctattttgcctgaccaagttatttaaaaaatcctttattcctgctataaaattatttcttgtgcataataaaatctgttgttgaagctctcacatgaattttgtatttcattcattgaattcttagttccagaatttttgtttcttttttatgatgcttatcacattggtaaatttctcattatgttcttaattgtcttttctgatttttttttgtattctttatctgtgttctattgtatctcactgagcttctttaatattattactctgaactcttttttcatcatttcattaatttcttttttattgtaatatcttgctggacaattattatgtttctttagatgtggcatatttccttgacatttaatgtttcttttttcctttcattgatatctttgcatatggtgtaagtcacttctttatttttttggattgtcttttgtaggggaaggtcctaaagatctatctgtagtgttggtttcacaggacactttagtttgattctgggtgcatgcagtaatgtagcctccatgtgatttatttgtctataaatagcctcagtggtatctgtgatttcctctgtcaattaggctgtggctgttagtgcaggctgtggtaaggctttgtaggggatgagaactgcaggtgggttggtcctcaggcctcggtggtgggccaagcatgcctgtctttgggcccacaggcagcgtgcatgggcacgaatgtaattaggtctaagaaggctaattcttggacctccaggtggctttcttgggttctggcagtggcagtattgggccatgtggttcattaagttcctgggtagcatgcatggcatgagcaatggccatatctgtgacaggacaaccccatgggctcacagataaaacatgtttctgttagtggtggctgtgatgagctgggtgggcctgcgcttaagcacctgaaatacttgcactgataccagtggtagtgggtggggcaagatgatccccaggtccctagacaatgtgcccaggcatgggtgatgttgccaggccagacaagcctgtcattaggcctcctccattgtgcacacaggtacaggctgtgatcggcaggccagggtgaaacctaggctcccctggtaaagtgctgggtggtggcagcaatgacagcaatgagcagggagaatccatcctcaaggcacgtgcaagtacactgtgggcctgtttctgggaattggggttattttcagtgacagcagccacagccagttggctctcaggctcttggaagtatacgcttcagtgtccagaattggtggaagcagcagccatggggagagccagtcttcagagcatgtgcaagttgaggattgctgaggaggcagagttgctatcagtgggagcagccccaggcaggcaagtttcaagttctggggagcacatgctttggctccctttgtcccaggggcaccttgctttgcctgctacaccacccataacctggggtgcaagttgctgtgtgttctatagtgctgaggaccctgctgttctgctgagtctaatcactctcatgccactgcagtcctgtaagggatgtagggagatgtcagtggggttctagggatgtaggaatgcaggggctgctgagccccagggagaaatgcagtctggtttgggccacattctcataatgacactgtgctacaactgcttaggactcagggtgtttgtgggacccagcataagctacctatctggagcgacgccattacacactatccaggctgcttcctgtggtagccttatggtctgcaggggtcaaggaactctccagtgactaggattgcaggagcccatcatgggaatgtggactgctggggcatataccattttcccacactggggtgactctccaagctcccaggtgatcctgaccaagctggcagctttacttccctgttttttttcttgcttcaggtgtttcatgacactcctctgttgaattccagtgttctgtcttagatgctgtattcaaagaatgattatgtacttgctattttagtttttctttgtggaggaggcaattgctgaatgcctctagtcagccatcttggagtcctgttccaatctttattttttaaatctgtttttacagtctttccattaattgtgttttttttaatcccattatctattctccacagttgattcaaacatggaaagtccaagcctaagaaatgtgtaatctaaggccttcaacatgaaaacatgaattaaatttatcttctcgtttgtctcatagtggttctcccactttcaaagaggagttaccccaagacttacctaagtaaatccattaattctagcattcacttaaaaggaaaatgttgagagtattgctgagatgagtgaaaaagaaatccagaaaaaaatgaattaggcctgaggacaattaataagaagtactgaaatgacgtgatatctgttgatctaaaataatccagccaaattttggtgaaatataaaatctggtgctgcacactggtcaatcggtataccatcttgggttagccaacagaatactacagttggaggtggagagcggtggcctgggtccctttacatgatcttacccctcccaccctttgatctgatcttgtttgcccattactaagttatgtcacttaaacatcatgatttaagcatgagagaaagaaagaaattgtcctataggaaaaggatggaaagtctaaactcagagagtaccggaaagtcaatgaggcctataagaacaccattcatgtattcttccttacatggtttatttttgtccctctcagttctccctcaatctgtttacttgctgttaagtaaaagaaaaacgtccgggagcagtggcttctgcctgtaatcccagcactttgggaggccgagatgggtggatcacctgaggtcgggagttcaagactagcctgagcaacatggagaaaccccatctgtactaaaaataccaaattagctgggcatgtggtacatgctggtaatcccagctacctgggaggctgaggcaggagaatcgctcgaactcaggaggcagaggttgcggcgagccaagatcatgccattgcactcctgcctgggcaacaaggtgaaactctgtctcaaaaaaaacaaaaaagaactatatcataatagttgagtataatataaagctggagtcatgttatcttggttcctaatgccacagaataaaagttgcattgatttcaggattctacaaggtaggaaaaaagcaagaagtgtgcttttaatttttggagaagttttccatttgtttccggagtgagtgaccattttgatacaagaacagcatttctgtgagaaaaatgcatactgtttttgacacattactgtgaaagggagccaaacacctatataattggatcctttcaccaagagctcctttctttaaagatgtacaactggactgaaatatgataaggggacatttttctatcttcccttttttgaaaaaaaataaacgaatgattatctgaatgaatgtagctgttccatccatttacaaccacttctgtccatatttcctaactctctactgagtcttaccacactgaatttctcggttttaattattagatttctgttccttgtccctagcagagaatagcgccctgaagaaacagctcactaaagcaattgttttgatgcttcaagggaaagagggatagtgaggaggggaaaaaggaataaactagttagagtgagaaaagaaaaattctgagaggccaaaatacagttgcttaagaaaagacagggagtgaaaacaatcttggtgcatgtcttatttatgccttgaactgaccttgagaatagacaccctaatattaaatccaataagatgtgttattagaagaaagtctttgttcactaagaagaatagcactatgtagtgataaaagacagaggggattcatgcaaagctaaatgatcaaagaactctatacctgaaaacctgaacctaaaatacttgtgccctgtaagccaagaaaggccctttcattgccctttttcccatggtgcttctcaaaatcattattagcaagtttccctgtaaaaatgaaacagcatgtctaacaacaatgaaaacctggtctcatagatggttatcatcacacattttctctgaatctgctgacaaagattgctttgtaataaaaaaatcaacattaatcattataatatttgagttgctcttatcaaatttacacatcaggcaggactagatgttacgtacatggttatgttcaagtaaggcattgcatttcattatttcaatgcatctctagagaaagttcaacttaaataaagctgtctaagctcctgaaaggcaatgcatcaatttttcaagtcttaaacaatggacaaagattgtttctaaggagagcagctaaggctctcatcttttaaatgatagacagtgttatatctaaggagcagctaaagtacccttcccctcaaaatactatgtttcccagtttaaaaaccctgggctgatgaaagggaaattacctctagttttaaatgcataccttgttaggagaccactatcttaagcacatgtagaacctaaaagtaatgataatacactatgccaaaccacaattattctcttcctcatgtttttaattaaatgtattgcctggcaagcttcctactgaatgccaaacaaaatacacattttacaaatgagtctatatcatgccaaacttcaagaggattctacaattactgaaactatgataaatttttaaaattctcagcctgaaatgtactatgtaatgaaggctttttaaattgggaaatatattcaaacgttgtttgctgccttcatttccataatgggttcttgggatctcctgtcagcaaatagcatcttaaattattgcattggatcctacagaaaaagacctagagaagaaagggttagagattgaaaatattttaaagaaaccagaggccagaagtctttaataaacagtggttacaataataatcaaaaaaaaaaaaaagcagatcagactctgaagtagagggcctgccactagctgaggtagtgcataagttaattagccattccatttttatacatacttcaaaacattatctcgtacacaataaatatatacattttgtcaattaaagaaagtaaaatgtaataaagataattttaaaacattatgggttagaaagtataatgaaaaaggctataataacccagtgatggtaataccatggacattttattcagataagtgaaaggaatatctttgaaaatttattggcttggcacaaacctgccagtcatttctgacactgcctcatccttgactctctttcctatccctgacctcatctcatttctggcattcattctccttcctcctttctcttttgattaaaacgagaaagaagaagatggtacaggtgatcagaaacaggtcaattaactagggctatggcttaaaaacaaaaaataccaaatgttttcatagagtcattttgtctttttaaggacagtgaatatctatgaaatgatttggtagtttctgctattgtgtgaaaacaaaacagaaagtttaattatattatttatatttttattccctaaatcgttgaaaacataatagtattaaagatcaaaaacttcctccttaatcctttttttctttgatgtttatatagaataagtcccataacatagcggttgattttatagatgaaaacaataatagcatatattttcttctgtaattaagagttagcacattcagcattttctgtttgccagacactatactatacacacactaattttatcagtataataatcattaagtttatagcactcttgtgcttgttttgcagatgagcaaactgacgaacagacaagttaaacgtagcttgaccaagtttcacaggtagtaaatattggagatgggatttgaactcagggaatgtggctacagagtccacttttaacaactatgctatgttgcctcccataaaacatatcgagttaaaaattaaaatattagaagatcaccttagccattgatgggcattaccatgaatgcaacagattgaagaccagggttaaatataggtgatgggtagttgggaggcccaccaacagtgacttcatcacacatagcagcctcaaggaatacagcctaaatctctgtcccagtaaaataaaaaatatatatatatactacattgcatagatttcgggggtcatgacaagtgattgaaatggccccagtagcctacagtcctggggtttctttcttgagatattattacttctttctgtctcttattcccattacccttcctccctctctccttctccctggcttctgaacgctacactgaaactcagccattccatgtgccatgctacatgggagattgcactttgatgttttcttttttataatatagcaaatggaacttttatctgagagtcttagctttagatataatcattttatttctaacattcaaatttagtgctgtgataaagtagattgaaatgaatacagacttgaaaaataagttttgtctgcatcccaggactgccactgattagccatgtagtcttcactagttgactttgctgatctgagcttattttctcttaattaaaataaaactgtggcatttgtcacatggtaaggaatagaaaatcaaatgttttacacaacatttgacacatagcagatgttcatcaaatgtcattttttctttccttctccttttacaaataattatattttataaaaatctaccttttcattttatttacttattttttactgttcttaaggtgcatcagcaccttttcacttttttaaattccaaaattacaatacttgccagataacatcaactgaatggattatattgagttccttcttacacctgctgacagtagtactttgcaagtcttgtccatatattcttttagtgagaaaaaaggaatataaaatatatacacacataaactctctctgtgtgtagttgttatcgtttaaagttgttatttaactcctaatacagaatttatttactcttagtgacagatatttgtggtagtataacttcctaggattatataaattagctctacaagaatagagctgaattacaagagtaggggaattctactaccagaattcccttacttataattctgtattagataaaaaagaaaaaaagtagttatcatggaagcaaccaaaaatgataagttgaaaagagatatagactcaagcaaggacacactgttcttctactattcaaacatgaaactttaatttggcaaatttctccctctgggtgttactttctcttgtaaagtgtcattccaaagttttgaggaccctataaaagtccttggaaaatcagctaatgaatactcagctagcaatcatcttgagtaattagtatcctgaagaacttttgggattcaagtctgaaaaaggaattgctccatgaaagagggaaaatgtttgtctggcattgtatatattagtctcctttctatttctcttgttccatattattcagagtagcctaactgctattataatatcaaaatgtcttagtagcttaacacaataaatttcattccactctcacatgatagtccaggcgaattgtgggtggtgggctatgtaccacatagttgttcaaggacctaggtaccctcgatctacaagatatcctgtcccctaaggctccagaaccctctgcacaagtcattgcatccagatatccaacaacagaaaggaatgagaatagatctcataggagacttctggggtcaggacagaaattgacacacttcactcccacccatattccagaaatgagatacaaaggctcatgtaactgcaaagaaagctgggaaatgtattctattccgttcgggaaagaaaagaaaacaaggttttgtgaactcacagcattgcctttgcacatgatcccaggggtgctaaaatcctatattttattttattttcatttcagcaacaaaaggctgtgttccttgtgaaaggaaattttgtatgtcatcaagtagatgggaaaaattgagaaagaactgaggcacttcactaatacagctgtaattacatgacatatactctgcctgggcacaagaccaattttatttcctattttgaaattgtcaccatctagaggatctattattaaaaacaaaaattacatgaattctactttgtgcacaataatagtgtttcatattcaatgttgcatttgcttatgaaacaaggatagagtgtattttcaagatattttaggagatcaacctgggagaatactttattactattgccattgctgctggtggcggtggtggtggtggtggtggtgtgtgtgtgtgtgtgtggagagagagagaagaaattcccttcctcaaattcactactacttttctaaagaaatcctaggcacaattttattttctgttcttcggtcctcaaatacctcaatttaccctttacctgttagtgttgtaacaaatcctagacagattatagaattcatagaagaatttcatggagggggaaaaatcccaagaaaaaacacaaaacccataggtgaaatcaaaggtagaattagaatgaagaatttctttggcaaagtttgttttttgttatattgtgggcaaaatagagatcagtaaaccaaataattttgatttttgtctttagtaaaacagactattttctccaggactttataagtctgaagatttaatatttttttgtgtgattttgtactgaaaacataacataataacaaacattattgtgttattatgtgcttacaacgttccaggcactgctgcaattgcttacttttcttactcacttctcatacccagcactgctgcatagaactgcacaccttttgcactacacacatttaagggcagccattcacagcatggacatgcccataattgcgcacatcacatcatatgctgcttcgcatgcccactctgttcctaaaatctattatctttgtcctataaacaagaaaacagaattttagacgctcaacactccttaacttttctccaacatataagaatacaggtcagtttcaaatgaatagcaaggagtttaaatccatgttttcagagctaattaaaaataaatcttgcagtgaaagcatcatcataggttttatgtcagtatgcatcttaaagcactgaaattcgacgggtacctcagaatcagtggaatgttttatatattgcaaagaaatatacagaaacaagatattcccagccgttgttctaagtgggtctgattaaaacattattctctgtctacctgaaccaatcccaaggattataaaataaatagccccttctttggttgaatttctttcatcagaaatctggcatgtatctttttcttttcctttttttcccatctacttgggtctgaaaagagatagatctaagggggggaattactatggttttctcccccagttggacttttggttcatagagacatgtaacctagttgtgggggtccatgatcgaccatccgatgttccctagaaccaacaaaagtagccattaatgttagctgagaaactttaccctagtgaaaattgtggtttctaggtagaagttcttctaaggacttcagcctattttgtgactaagtttgttttctataacatctaaagagcacagctgtctaagaaacactgccactcttctctgctctttcttccaatggcaatgaaattcttgcatcaccctaaggagaaaactagagttggtagttgaatgcattttaattcttacagttccctctgtaactcatgactggcatcactcctgtattacttgttccactaatttttcttcatgcaattcttgcattagtttcttatcgctgctgtaacaaatattaaccaatttgttgacaatacacatttattattttatatttctggaactgggaagtccaaagtaagtttcactaggctaaagggaaggtgtcagcagggctggttccttctggaggctctgagaggagaatccattctctcaccattttcagcttctagaagctgcctgtattccttggcttgtggatttttctttcatctccaaaggatatcactaaaaggtatgcttctgttatcacacttatgtccttctcctttctgttctcctgtgctcttgaaaagactcctataatatcattggaccaacacagatgatttacaataatctctcctcacaggttttgggaatttgaaggtggacatcgtggagagccattatttagcctacacagccctcaggagtcactaccaagtagtcagaatcagctcctatgatgaagctattgattttcctgcatttaaatcaaagcagtcagttgggataaattgacggtgttatggtgattatttctctagattgccagttattttttaacatgacctatattattccaacttccagtgaaagggtcaggttcttggttcttaattatttgctagctgtatgctcctttacttacaattcatatcgaaggtgggtggcctggaaaaatttggagacctgagagaaccagaattacctgggaagacactttatgtgtctggtgctactctccttccccgatacactacatattaagtttaacctgccttttccctctcctggtgttacacattatataaatactccttgaaagcacataaggctctggcgtggggcaaaaggaagaaggaaacctcttctagggtagatgagaacatttttttttcaggtgattattatatatactaatttcctctttgacacccatggaccttgaaaaccctagtacatgttttcataagacattcaaatactatataaatactgcatacttaaaggcatcacttagggatgacattatagttaaaactacttagtaatcccctttattgaaactgtgagatgtggtataaacttctcagtggtgcctttccagactcatatgagtagtaagaatgcacaaggaaagcctttttttttttttttttttccgagagggagtcttgctctgttgcccaggctggagagcagtggcacgatctcggctcagtgcaagctctgcctcctgggttcacaccattctcctgcctcagcctcccaagtagctgggactacaggcacccaccaccgtgcccggctaatttttttgtatttttagtagagacggggcttcacagtgttagccaggatagtctcgatctcctgacctcgtgatccgcccgcctcggcctcccaaagtgctgggattacaggtgtgagccactgcaccatgctgcaaagccatttttatcttcccttgtacatgggaaagttacccctgcaatgtcctcctcaccaacacccccccacacccaacaaaccaaaagactaaaagtcattattcgttgacaccctctctggacacaatgggaaatctgtactcagcaccaacatttgaaaacaggtcttttcttgccttccacacattacttctctgagtgtgcacattaatcaaagccaatgtactgtaaataccatcacactctctgactgtgagagtccctctttttcctgttggcagtggcctcagcattaatcatgcacatgattcttacagagcctgggcattttttccagcttcgctttaaaccaccgtgatatactggctgcccctgctcctttcatatcagaccaacttttataagctcagaaaataatcgcattcaatttaggaaaataatataatttagccattattagttagcatctgaccttcttaaagcctactgactcacttcttattctggtcatggcataatattattctaaggtccagatgaagaaacacacaaaggtgaaagagccactaacttagtcaagaccaatcacagctaatagattcagtacagagttagttcaagggtctgccttgccaccagtctcaggccttgttgttgtttctgagatgacaagacctttggcagctgatctttggcatgccccccgcacccccaccattctagtctagtacagctataggtcattaaattttaggacaccgtaaagcttactattttcaatcagcttattcagactgagtatgacttgagacatactgagttatgcagctagttttcatgttaatgtgtcatttttgctgctctcaattgatttacatgctttattgaattacgatattgtgcagtgacccaaagtcaatttttaaagggtacaatttaaaaatttgaaataatcagccttagttcagacgtatacattatttaaaattttttttctctccatcagattatttgatcacacaggtattaagcctagtacccattagttatttttcctgatcctcttcctcctcccaccatccacccttcatgaggcctaacatcccattatttatctattgcaaaatgatacaacataatgcctcttcaattaacaaatgttaaagcaaaatcaccataatacggtagttattcggcatcatgtgcagctgtgagtgatcctccttctcatgtggatgtgtccttgccttaaaaaaatttgtgcctcaggaaaaaatagactaacaccatacttaaatatttggacctggctttatattaggtagctccatctggagggtctcatattggtgtcattctgaaaggagtataagccaggcttttagatcctccctccctccctccctccctttcttcctccctaccttcctttccccctccctccctccctctcttccttcctttcctcccttcctcccttccttcctccctcgctccctccctttcttccttcctttcctcctccctccctcccttccttcctacttcccctccttccttcctggaaggtgtgcgtgctgtgctgctgccccagcagtgtgccttaagtcacagtgccaggatgtattaggccacagcctttttctacaacagatctatttcatttaaggtctgccagttgtctttctgaaaataggcctcaacgttttccccaaatactcttgaaaaccatctgatgacatttgagcatattgaaccgggctgagaaggctgcctttctctactgcctagaactgctccccaaactctagtgtttcttttttgaagacaatcactgaaacatgagatactgggtctcaattaagtggggttatttaggaagaaaagaatagaaaatgagaaaccaacagccacgtgacagggaggttactctgaatataattcaaatcctttgcagctttcaggaggaaactcatagaatatattttggtggcttacacactggtgctgaataacttctttgccacttaattggaaaaaaatatgacattttcccagaagactgaaatcattaagactgtgcctgttccatgggatcagttccaagaagtctaatatgtttacgccaggagctggcatccgaaaggcgtccctcttcacattgagcttttggtgtcttaaatggcaaaacattgatagcttcagccaaataggttgctttggggcttctattttattctctgtccagaatagagcctttacatgctttatcttcattctctatacgtctatgtttctttatgttatacctgcattatcatgctactaagttatgtataagatgtatacagaaatatacattttaaagagatcaagtaaagataaaagaaactattttaaatatcttgctaatgataatgtcattaaaaacaatctcaagatgcaatattccctcaggagaaatttgtgaatgagtattagaggatgcaaatctgtacttcaggccgggtgcggtggctcacacctgtaatcccagcactttgtcaggctgaggtgggtggatcatgaggtcaggagttcaagaccagcctgaccaacatggtgaaaccccatctccactaaaaatacaaaaattatccgtatgtagtggcacgcacctgtaatcccagctactcaggaggctgaggcaggagaatcacttgaaccctggaggcggaggttgctgtgagccgagatggtgccactgcactccagcctgggtgacagagtgagactcaatctcagaaaaaaaaaaaattctgtacttcacgtagtcttcttgataactaattttactggcctagttcttttcagttttgactggataatcactgattttattttgcaatgttgctgaccatcatctctactaagattaagagaagtgccaattctgacatcttgttctgtttgggcttcccttttaattatccttaatccatagtttattttataaaaaaattaaaacaatgggtcgcacttaaggagggttataaatccaggtatctttgattgtgataatgttgaaagctacagaacaagtgacagcaccacagacaaccctttaataaagctctcttgtctgggatatacactaaaggagagtgtcaatgccaatcatacattaaatcctgggaaggctacaatgtttacgttttagataacaaatttaaagaaactttctaatattttcttttcactctcgaaaagaacatcttatagccattttgaagactaatatttaaagccataactccaatgttattttttccagattatatttcctgttgcccaaagcagggtagaaacctttgatttctctcaacatatctctcatcttacccatacctcttttgagattgtcacccctttctacctcatggttatgtatatagatatcttagttcttgaacaagattgtaagcatgttgaaggcatggtccatggctgactcatgctcggttttcccagagaatctggagacacaacagtagagagactagccatggtcttacatatcacagttcttccaaaaatatacgtgtcgagagatgaattaatcaattcctttatctgagttgcaaataagcttcatggttttgagttttattttgtatgcttggttctattaggtatttccaaacaaaagattatgagaaagcatgtagagaaaagatggaaggaagaaaaaggtattcatttttttgaaggttcaaaataaaggtgacattcataatggataatcatttttgaaaccaaaataggcagtgaatgattatccgaaaacattgttcattctaaaattgttagcatgcatctactttcaacatgttactatcatctacgatgtagcctcctttcccttggctaaatcagttccaaatagaaactgtcaatgaccataaggacatatttttattgctcctcatttcagatgctggatattagagaaggaagtagtatgtaagttaaagaataactaaaaagtagtttattcctgtgagcacagatgctatagtaaagacaaaaagaattatttttaggggctttttagaccaacaaaaaacaaaaggagaaagaggaattcaaattgaaaactggaaaacattgttacaaataatgataataataaaagatctaaagaacaaaagagcagcttattttcaaacatagctattattttagaaacatggaaaataatagctgaagggctgggaattgtaggttctactctgtcttctaagagctgagtttgggcatcttttatagcaaccaattttccatacactcagatggctcccaaggatcactgaattgagatgtatgatttaattttcctttcaaagattatgttcagattattatgccacgcacatgataactaattgtagggaaagtgtgtcaggccaggcttggtgaaaactgcagaggtttcagctgtgacacactgtacaaaatgtaagcattcagtcaagtcatatgcattgcaaggccaccactaccagaaggtggtcttctactagagtttgggtcttgaaaactagaatgcatgtcaaccaactaagaagagattcttagtaggcataagcctatgttcttgctgcggtttctactttagcaatgaataggttaatgtcaccctgtctctggcatttgtagtcacccatttccatgggatgacacctcattctggctaatcttgtgttgatttgaaacacagaatcctacctcatccctcacttgacctagtctattgctttgaaatgaatgaagtcttaatttagagatttcagcctatctgtggtcaccatagatgccactcgcaattcccctccaatgcaattatttctcttttgtgggttctactcccttttctcttcctccctcttggccacattctcctcctgtgacctcatcttgtatattttatcttctctttctctttcttttctcactcttgtttcttttttattctttgtctcttctctttctcttctcccttactcccttctattctcctgctagttaaaaccagagacacttgttactcttacatgtgaattggagaggtttctgctcctgggtttcacagaagttttaatgctacccatactggtaagttttaattgtatggcattttacaacctaaacaaatttcccacatatattgcattttttatatacatagcaagtctggagtataggaatggcagagattattagccccaattacaaaaaaaaattgatgtgcatgcaagattgtgccttgaccaagttcatactgtcagaaatgtgtagagtaggggtcaatcaagcctggcacttctaattcttgtcccatatttatactattccagtttgccagtttcatttattctcttaagggccaaaaatcgacacacagcaactctctttctcttgttttaattgtaaaagagtctagtttaccaagacactttagaaaaagtgatatcacttccatgaagggttttaattcacccatacaattaacagttgttaatttgttatgcgtgtggcactttgctatgctgtatgatggataaaaacaagaataaggctggggccctgctgtctgcaacatagaatgactggatgaaaatgacaccccagtggaaagaccattttgggaacagactcttttccctattagatcttaagcttcatggatgcaaaataaaatgtggcttattcacccacgtatttgtttattaatttattcattaaatttatttatagtgcacttttaccatagaccaggagttttcctaggcatttgtatccataaggcttgaaatcaaatagggaaaagagtaaagttaaaaaaacaaatgaacatgtaaacaaataaatagtaataaggtagtttcagatgctaatagatgtaaggtgaaaataaaactgggtcatatgataaaatacttgttggtgtggggagaatattagttgaaggaaagaataatgtctgaatcaagcttggaattgaaagaagaagttatgtactaacagtaagtgaacatgaatgacaaaaaagacaactgttacatttaaagtccagttggggttttaaaaatctgacccacagagatttcccaaaggagctaatttctctcttcaataagtaccataaaccatacataattatattaaaagataaaactaagtaaaatgagacaactgcataaaaaatacataatcatagataatcagagtgggcatgaatcatgatatttcacaatcacaaatgcctttgacctataccattatagaaactaatagttgaatggaaacttgatggtcaattagtctggggtctctcaactgtggaaataatttctacaaactccatgactaatagctgtctaatttcgcactgcatatttccacattaggggcccataactccatgggatagttttctttttgctagattgacagctttaactatcagctatttctttaaattcaacaaaaatctgctgaattcctcaaattggtcctagatctattctctggaacaacacagaatccactggctacagtgcatcatatatcagctcttgtcacccaggctggagtgcaatgggaccatcttggctcactgcaacctgtgcctccctggttcaagcgattctccttcctcagcctccctagtagctgggattacaggcatgtgccatgacacctggctaatttttgtatttttagtggagacagtgttttgccatgttggccaggctggtcttgaactcctgaccttgggtgatccacctgccttgggttcccaaagtgctaggattataggtgtgagccaccgtgcctggcctcaatgtttctttttatatactgtgcatgtatattattttcatgaaatacaatcctaaaggaaagagagtatattaatttaaatagtttagcatattatatcaaccattgtattgagtggaccagaactgaaaatatgccttttgtcaaaaactataagtctatataagttacatatgagtatcaaataaaattatatgtatggacctgaactatggcaaatttttaaatagtggatcttagagcatgtgcatgatctagacctgcactgttccacgcaggagcccctagtaataacatgtgtatattttgtacacacatacacacatcacacactagtattttgctaacgcgcttttaactgataatttcaaatgtttctgcaagaggctttgatgtcaatgaaaaccttttagtcatttgaagtaaaaatatttttctattgatataaattatttcagcattgaattttattaaaacaagtatgataaaggttgtaaagtttaatttaggcaccacattgtcaaaaaatacgaccaagttttttagattttgtgttagctgtgttcctagaacatctgttatgctattatgacaggtgtttattaatatggatgtctaatcaaatctcttggttgctaatagcttggcaattcaacatctaaatattgtcaaaatccttgattatatgttgaaaactgtggataattgattcaaagctgtttgccttgactagattaaaaaattaaaacctgtcaagtgtattaatactttcctttaaaacctcaacattctcctgaaatttctaaaatgtttcagtaataacaacttgtgaaggaataaaagtcttctacaggccaacatctgtcctgatccaagtttccttagacctttcattatacgcataattttttttttttatttttatcatgggctaggaatgaatgcacagaaggggagtaacaaaatgaaagtcctacgctacatacaaagaatgccctacagaaacgtgttttgggtgcatttaagctcagatttttaaaattaaacttttttgaaagtatttaataatttctgaatagtagaagcctgcaagaagcaatttggtggccttcagcaatgtggttgagtagcttcaatgggtgccatttgcagctcagttactgagctggaatttccttttgaatgtacaaaggcattacataaatctctaggaaggttctgtggtaatagcattcaatggaaatctttaaaattcttaaataacgattatagatttgaaaagttcccaatttatttccctctgacagagtagttctctcacttctatgagatagtctgccttttagtaaatgctttaatgactataaatgtgtttttggtctagtataagtactgtccaataacacttttgacaataatggacatgttttccatgtttccactgtgataaccgctaggccaatgtagctactgagtacttgaaatactttttacaactaagaaaaaaaagtttacattgtatttaactttaattaatttgtacttaaaaagccacatttggctaggggctactgcatggaacaatgcagttctagatcacgctatataactttttgatttgccaggtgcggtggctcaatgcctgtaatcccagcactgtgggaggctgaggcgggtggatcacgaggtcaagagagcgagaccatcctggccaacatggtgaaaccccgtctctactaaaaatacaaaaattagctgggcatggtggcgcacgcctgtagtcccagctactcaggaggctgaagcaggagaattgcttgaacctgggaggcagaggttgcagtgagccgagatcacaccactgcacttcagcatggtgacagagcgagactctgtctcaaaaaataataataataataataaaataaaataaaataaactttttgatttaataaaatttactttattggagttcaaaatgatgctaaatgatttttaaaaatacatacttgagctagaattccttgattctatcaggagaatattaaccatatcaacacctaatagactagtctttctaggcattgtttgctgtggtagaaatgaaaccactatagcaacagatagttcattaaaatagggatatattcagaatattgtccacatgacctaggagtgacaaactgtaacttccaagctaagttaggacaccacttgcttttgtgaataaaactttattggaacacagccacattccccacactccttcatttatgtattgtcaataagtgcttctgtgttacaatagcagaattaagtaactgtgactgagattgctgggttgcaaagcctaaattatatactggtctttccatagaaaaagtttgccaactttttcgttacctacataaatagcagaattaagtaactgtgactgagattgctgggttgcaaagcctaaattatacactggcctttccatagaaaaagtttgccaactttttcattacctacataaatgcttatgtgtaaatattaggataaagtcccttttatggagaagcacattcttctcagttcattcaccatacttaacacatataacacacattgctaattcctgtatcttttcatatatatgtaccatataacatgtaatatgttagatatgaaattatatgtacatatatatgaaaatatgcagcaatttagcaagtatgatactaaatatatatgttaaatatttagcaaataaacctctatgtgctttcactcagatcacgggaatttaatgcacaaacaatgatttatagcatctgttttctaatttaagttaaaggtgtgagctaacatgtctctccctagatcttgataatcagatagtatcagagctagagtggaacatgaaagtgcattccaaactcattttagagacaatagttgggagatgcctaaggacacaaagagataataaccagttaatcaactatttaatagctcatttattgagacacacctatttatgtaaccagccagaaggcctagtagttgttttgtaccattcagaaagacagtgccttaagagcccaggctgcagactgggagcaaaaccctttgtgttgtcacagtggctgtgctatgaatgacatatgcccttacttcaatccaacagggaagaaagacgattcttccctggaacacttatggtctatcatttagtgaaagaagcagttggcaaaactcaccaataatctatctatcccagagaagagtctctatctgctccattaagcacctgtattttaggctttattatttatttttacagtaattttgaattgttttgaagactgtctccaaaatagaaataaccccacttggattactgtctaaagagtgagtctaattccattgggattctttttaaaaattctattcattgataggaaaaaaaatctttaacttaaaagctactttctgacctcagtagaactagtccctatttttccttctttatacaggcaacatatcataaaagagatgtgcttctattctcatctaaaatattaagttttaaggtaaaatatgacagtattattttcataagatattttcattaaaatcatcatagatttctgggtgtcaaaaatagaaattacaattgaaattaaagtataatgacagaaatgtaaatttcaaattctgcattagtataacctctaacctttaccagaataatctcacttatcagatacttaaataaaaactaatatctcaacttagtatatttttctctcccttttttcaatctaacaatatggaacttgagtttataatacaataaagttcaccatataatctgaactacataaatgcctggactatattgccttttcttcagcaacatgtgtcgatttagacctttgattggattgtggaatgcagtaacagaacaaactaatcattacaattacattatatcatacaaccaagaataatttataatatgcttcttgtactttttggaatcattgttctcataccagtgtggtgccttattaatcctatgaagtcagtcatatggtgataaaacagatacaaaagacttgccttaatatgttattattattgacttagctctgaccacaccacctgatggacaggttccaagtaaagacctagatagtcaaagtgagtactattagtagacttgaaacatttaatttctgttggaagagatgactaaagctctccatgaattctttatttatatcacaatctgaaatattattaatattattgaatgaattttatttgaactggaagaaaaaggtaaaaataaagtcactatagtgctatagctgtgaaaatttggctgacttacaaaatggcagtgagttggtgaattaggacaagtggcttccagagactaaagaacctctaaacttttatcatcaacaggcacatttaggatggatcatcctaaatatcacttaatcatgtggccaaacagaactattgttaaccgacaaaatgctatgcattgaatttctggtttaacaaatgagaaaatgggttttgtttacagtggcagttcagaattacatacttataaatattgaggttagggtctattaatgggctgtttggttctaatcatctgaagaataattcattttctcacagagatacacatgatttgctttcatatcctatacggcctcctttatgtttattcaattttgttatcatagtgaggtatatgaaagcccatgagctcggaaggtactatctttgcatcatcttaatcctttggccataaaagaaaatgattggtcctatagaggtctcctcaacttcgtccagaaacaagtgtgacatgatcgaatctctgtcatattatatacaacttacaaaagatatacatacccatagccatgaggcgcaagtgcatatctagttctatatgaggatacagctcaaatacacacacacacacacacacacacacacacactattttattggctgacaaagaataagtgcagaagtatcgagtatataaaatcactaattatgaatcaggagaactgtttgtattcactgctttttagtttagttttattcagtaaagcattgtactacttaacttgtttttgaagtttgcatacaaacttcgtgacatacaaacaatgtgaaagcattgtaaattttttcttaatatacatgcagtattattttgagaaaaataatgtcaccctcagataaacatccagatggttttacaagcacaattatgacatctattttaccagtcattctttataagcactcacaattcaggtagagcaattatattgcaatattacttacttattacataatcaacacttctgtttgtatgaaatgtcacattacatctaaagccctgaaatgcaatgacctacagagaataatcaattgtttctcaaaccgttcactctataaaatatattaaattttgaaaagaggaattatcttttctatctgtaaaatgagagggtggagcaagaaaaacttgcaagactttttagttgttagatatcataatttgaagcctttttctttttcaataaatgattcctcagaattacatagactacatctttgaaggaaaaaaaataggaagtgatagatgatcaatcacattcacgtttatggtgggatatatttattttctattttagttataaagaaaacttgtttccattttcagctatctgaaaccagttagagagacagttacacagatgatcaaccatatggcattaataaatgtataaccaagacagatatgaagcattttatattttaaccaaatggctaaactaactcatgaaaatgtcatatgttatctatttagctgagagctttattgcagagaaattgtgtcataattaacaattaccacaggaccagccatttcattttataattacttctcaaacaaattaaggaagatgaggttttacccacattcagttacagctacattcaatttcataggtaggaatatgtaaatgtctatgttttataaaaacaactcagccagctctatcagtagtatttacatagaagattcaatgggaaataaaatcactgtaattaagtatacataatttttaaatagatcagtgttgtcaacctatctttcgcttgccttcatgttgaaggatatagaatagaaatgggaatcagatcccccccaaaagtgggggatcccacttctcctactgtagcattcccaagttcgtcttcttttgcctatatttgtataatggggttatgcctaaagttttgatttttaaaatgattccaatgcttctgacataaaaaaatctgttgctgaaatacttgaatactataatatattaaatgatctaagtaaacataggactacagaaaaaagaatatgagaaaaggatcaaaaggaagtaactgataaaagtcaaggagaaatcaaaatttaaataaaagaaatgggcaaaaaaaatagttaaaaaattgcttagtgtagtttgatgttcctgcagcttcaaagtctataaaatgaattacagtgaagtaggaatgttaactttttttgttttctgtctacttagaaatggaaatatttagcataattagtccattagtgtttcctctattttatcgctgcagtattataattaacacaatattacattcagtatagatatgagaccaacttatttacctcagaggaattacaatggaaatagattgagttctccaatgctacctgatttttaagcatttaaaacttaataaaatacatgtatttcaaaacttattctttccttcatcacaaaatactcatcatcaaaaaccatagttgaatgtaattttctgtatttcaattgtgtcaataaaaatggcaaataacagcaaaacaaattccattatcattttaaagcttataagatcaattttaatttgggataaaggcatcccttgcatgcatctatcccaggaagctaagtgcaaaagtgcaggagggtagacttgagctgaagaaagtggaaggtttggccaaatagacaggagggagtggctggcacatatgagttcctgggaagagactgcttttgcactctgggaaaagactgctgattttatcagaacagagaccagaggggtgatggacaaaaagttggagagtagagacctggaaagcctgcaaggctgacatgtttagggcacctgtattctcaacactcttcaaccaacactgaacattcctgcagaggaaggcaactggaaaatatttaagcaggattaatttatcttacattctggctggtaaactttctgatgctcagggagccctagttagcctcagagataatttgccaattgattggaatatttcacatgcttgaagcctaaacacttgctgatgatctgaatttttttttttttttttgagatggagtctcactctgtcgtccaggctggagtgcaatggcacgatctctgctcactcactgcaagctctgcctcccaggttcacgccattctcccacctcagcctcccgagtagctgggactacaggcacctgccaccatacccagctaattttttttgtatttttagtagagatggggtttcaccgtgttagccaggatggtctcgatctcctgacctcatgatccgccctccttggcctcccaaattgctgggattacacacgtgagccactgcatccggccgatgatctgaattttattcatggttgatcactgactctttcttgatcactgactctttcttgatcttttgcttaaccacccacagctcataagtatctctgttctctgcccacttagagtaatcgtcacttttgtaaacgtctgtgatctctatttgtcacggacatgacttaaagacagaacgtctggtctacatattgtttgcacaccccgaaacatcgaatataagaattgtaggtgctaaaatgctgttaatacttagactgactatatcaaacctactaaattaggaacttaagaggctgaatttatccaatctttttttaaatggcagaagaatcagtgatactgaagagcaatccacatcctcatgtcttataggaggattgccaaactggaggaaattgtaactactatcaggggatttgtgtttgtcgttattctttgttatttaaaatgtgaattattgctgtcggtacttataataatactttgcaaagaatttacattaaaaataacgaggtatttgtaaatagcaatatgttgaaaacaagcagtgaactttggcagcattcttactgcttcattcatatttgcattatttataagatgctaattgggctctactctaaaggagaactctaaatatggtactccacaagagttctaatttagttaagcccaaacaacaaatattcatagagctctcagattctgaatattccatgttgggcaaaccacagtattagtgtccaaactgagacagaaaaacaaaacaatactaaacttagaatatttttagcttgattgaatgaatacttcaagtaacatatcttttttccccagaataatctggaaattccatatacaggatcttggcttttttttttttttttagatagatagggtctcgccctgtcacccaggctggagtacaattgtacgaccgcagctcattgtagccttgacttcccaggctcaagagatgctctgccctcagatcccaaggagctgggactacaggtatgtgccaccacccctggcctattattttatttttatttgtgtagaggtggggtcttgctatgctgccaaggctgttctcaaacttttgggctcaaacaatcttcctgtctcagcctccaaaagtgctgagattacaggcttgagccaccatgcccagcctcgaagatgtctttcataaacgtaaggatttgatttttgactttgaatttccttggactagttgatgacatgttcaaccttcatatgctgagttctcctcactttcaaattacttctcaaataaatagcaaaatctccagtagctttaaacaaaagttatatttcaaaaatgaatgatgtatagttatcttcaacctatgcgcaaagtacaaggttgagaaggacttcatttttgctttgatgaaaggcaattccattcatgattctctttaaattcttcagtattaacatctaccaagaaaagaattcactgttccatgacctgagatgcattaaaaattacatgtcaaatctactttacaggcaaaggggaaagaggaactgcatgtgtcctatatacacttgctttaccagtagcatgacacccaggatatgcacatgacacacacacacacacacacacacacacacacacatacacacacacaccaaaagcaaccaagcttccttagcaagagatacacaattgcttaccatctgggttccagatatctaagcatatcctcccatactaaacacttcttaccacacaaacctttgatgctactatttggacaactttactcctatatccccttgtggtctcatctttattatttagctgtttccatttccttagcctataatcgttatccttgcttctccacctagttaattccaatttatcctatgccattcattgtttaatttccacctcttctctaaaaaatgtgaggacttccctaaaataatcagttgctccctcattgttttcccatatcacttggagtagaacactgatatcaacccatatccagttattttattgttgttttaaatagtgtgtttgcttccttgctagaattcgaacacctcacggaccaagtcaaagtttttaaaccaaccatctctagtacttagaacaaaacatatcatgaactttgtacataataaatgtttttagaaagcctttcactacctattttccatgtttgcttaaaatactaacccagtcaaagaattataaaataaatattaaaaatggttttaagtagttcgtggaattgcaatgtttacttatgttgcaacagaggaatcagtcacaactttgcatttagtaaacatttttggaaaatgtagaaagttttgaacttgttacttatctgttaacatacatacctcatgagttttaagtggcaaacagagagagggagagagagagacagagagatacagtattgaagcagaatgttgactcatatttacatcagcaaattttaacttagcacctggtctctctatttccagtaatgaaaaatatggaggtgaaatacattgctctcttactaaagaaatatagatattagataaattaaagtatgcctatgaatgttacaacaaattatactttaaaagtaccagcacaaatgtgttcagtgatgaaatgttgcttgaataaagggatttgagttctccctagacgtattgtgaaattgcttcttgaagtcttgctgagtctcacttcctcacccataaaatgagaagatggtctacagaaacttttaggccttttaaatatttgaaacataactcttgataaataaagtaatttacacaaaagctgaattgctagtgcactgtcgcagttccccaagtctccttttagaaaaaaaattacaagcttttatataacggagaaaaatttctacacccatatgaaactcgttctacgatattttaaccaatacaaagtttatggtgactattcagaaacatttcttctcacaaataaactagagtcagatagcttcttgttagaacaatttggtttagtgtgagtcaaaagtatgtagctcctctagttatcacagaaacttataccatacacattttttttttttttttttttttgagacggagtctcgctctgtcgcccaggctggagtgcagcggcacaatctgggctcaccgcaagctccgcctcccgggttcatgccattctcctacgccagcctctcaagtagctgggactacaggcgaccgccaccacgcccagctaactttttgtatttttagtagagacggggtttcaccgtgttagtcaggatggtctcgatctcctgacctcgtgatccgcccacctcggcttcccaaagtgctgggattacaggcgtgagccaccacgcccgaccccatgcaaaacttttaaaaaatcaaaatttacccaaagtcgttgatacagtttcatagattgataatggtttgaaaatgtccatactttgttgtatgaccgtttaacaaaatgtaaccattctctgtaaagatgtgtactgatctttacacatacagttcagaaaaatcaacatattgacatacactttcatgaccagtcaaattaagaaacaatcactgaactctttttcctaggtaacatatgaggtcaagactaaactgtttgataatgtaaacaatggctggattaagaaatggaacataggctttcagagatgagtggcagacctggggaactaattaaacagagtcaaatgatgaaactaatctatgacaagcctgaaataggctaaaacaagttgcacgagtaaataaaagtattgcaagtcaagagacttaagaatcagtgatacagagagcagaaagctagatcctctgcagtcagcacccagcttgataatgcatcacagctggaagaaaggggctgctgattatttacagatcatgatttctaagccatagtacatgaaaacattcccaacatgaatagcaatatcttttatgtttttaaatactaaatctagcagtgacagctttgcatctatttgaatgctttggttaacagtaattagttaagaggcaatattggcttctgcaagaatgcttattttaaaataaaaattctgccaatggccattatgttacatactctatttgcatttgtccaccattgcagacatctcacatactccagagtgaactggagaagctctctcagttggttagagcattgggttaatgaggacaaggtcacagatttaatcccatacagcccagttaacttggcagagaaaaactttgctgcacaagctctagctgctatttcagcaaaacccaattgtaaattcatattgtggatcacaggggaagcttgggaaacagtggaggtgatgaaaacaacccacccatcctgtttcctggaaaacaatgtcaaacacccatgggtcaagtcagcaattgctcattttatttaaataataccacttttttcctgaatattgcctagccctgaatactgttggaagatataaattcagataaatgtgttttacatcattgaatgtgtttttgctcatcatctactatcttcctcacatctatgctttgttcacctgtatcaaaggagtaattcatacaccctaagcagcaagttcaacttgcatcaggcagaaatggtgatttccaagggtataattatgtaaaatggagtacattttctgagcctcagatttagaggaaatttttcagcaatgagatatatcaagccctactaaaaacagacattttgctccctaagcattacaaataagagacatcctatttcataaaagactcataatttaaaaatgtgtctatgtgatagattagtgaattagctgcaacaaaatatcctacatgaccaggccaaatattagaagcagcacatatgctgtacagtatgaacatacacacacactcacatgtgcacacacgcacactcaagctaaaaatcaaaatgtgagtgccattgtctaatattagtttgttttacatctcccccttcagtcacctgttttgaatttttgagagcgtatcattaaagatcctaaagaaccagaggaacaaaataaagttgctttaatgaagttagatgaactagctccttctgatttctagctctgtcactgaatgtctgtgtcatcctgctttatatgtgctttagatgaaagactgtggcatctgcttcgtataggagaaaatagagttaaagggttggctcaagatgccagtcattataataattcccatatttaatcctctatgttcctaaaaggctttttatattaatgtttactttgattaaggtatttaatcaatgttttcattgaactgagttccatcactcctaaagtttttatccctttcttccggtttagtctcgattgttctctaaagcacagaaaagggaagatatatttaaaacttctatcaaaacaaagtgaaagagtagaatcattagattttttcaggaacatctgcagaacaacaagggccaaaaatgacttcaaatgacacataaaaatgtctcagtctaaaatattggcattctgctaggccctatttgactgataagtattatgcattttcctctgtctctttcacctacaaggctgagcaacaaactgtgtctagagtttcttcattttaatattcttgttgttccatctgggtcatttattaacaaatcccacaaaagtgtatttgagtcatcttattggtcatcttattggtgttattgacacaagattttgaagtcgcacaataaatgagaagataaatcagtttaaaaaatcacccatggttgagctctaatataatcagatttaaatactactgtatgaaaatggtgcttctaagtaatattgtaaagtttaaacaacagtagtaaataaatattagcatttctaggggttattttttctcttaagttcagatttgttttttattataaacactgaaataagtcaaataagttaaatagataaaataaaacaaatggatataaagtctagggatttaaaaaatcatcttattaattttttagctgtggttttatttcataaggtattataaagaaaataattgcaatgtgaaaaatcagttctgagtttgctatggctctagtttttgtggttgtgtgacattaggcaaattacttatgttcttgcagtttcaatttccaaacttgcaaattggaagataaaaattatactaaatattataattaacacataagatagtcacacatactaggggctcaaaagtttagtgatcattttattaaggtgaatatattaataattgtgttttatgcatatttaacaattagtcttattgttgttagtaacactaggtccaaaatgaagtaatcatcatcaacaacaactaaaagcttaaatgtctgtctctccctgtgctcaccctatgtgctcccatgaaataaggtcattgaataggctatgccagaaatgtgctctctactggtaatttttcatcttgtgaatgcttccttattaattagatctcctcataattgtccctttcttagggaaatattcttgacctccctaagtcatcttgttttatttttaaaacaaaaataagagcacttaccactttgtaatcttgtatttacttatggttcacagtaaaggaagactcaatttaggattacagacacaggctccagactcagcaacactagtcatagcaaaaatgaggctaatatttggtttataaatagtcaacgccaccccactccaatttccctcctttatcttggctcaaaaaatactgacagccaaaatttatctctcaagccaaaaggcagaaatttcttctttgaagaaatatggaaagcatattctaagaattctctaactgcttacacaaatgttgacaatgacagattaaagcatttagagtcctccagtttaaaggacagattcatcctactcattctttgtcaagtgagacagacaaaacctgcataagtatataggcccccaagtctgcctttcttttacttatacttaaatatgaacagcgatccaagcattaccatacatttgaagacagccttcaacatggaaaaatcagttttttaaaaaagggaaaatggactgtaaactagtgcaaccatcgtggaagtcagtgtgggaattcctcagggatctagaactagaaataccatttgacccagccatccccattactgggtatatacccaaaggattataaatcatgctgctataaagacacatgcacacatatgtttattgtagcactattcacaatagcagacttggaaccaacccaaatgtccaacaatgatagactggattaagaaaatgtggcacatatgcaccatggaatactatgcagccataaaaaatgatgagttcatgtcctttgtaaggacatagatgaagctggaaaccatcattctcagcaaactatcgcaaggacaaaaaaccaaacaccgcatgttctcactcataggtgggaattgaacaatgaggacacatggacacaggaaggggaacatcacacaccagggcctgttgtggggtgggggaaggggggagggatagcattaggagatatacctaatgtaaatgatgagttgatgggtgcagcaaaccaacatggcacatgtatacatatgtaactaacctgcacattgtgcatgtgtactctaaaacttaaagtataatttaaaaaaaagggaaaatgactattggggaagcagagattactcaaagaaaaggaatagaagttaaactaaacccaaataaaattctccataccaatattgctaagatgatttatttatgaagacagtgtatccataatacaggtatagggtgcagtggggaaaaaaacaaacagtgaaagaacaacaaaaaatgaaactaaaaggtactttcagtggaagaattggaagataaaatgaagaataggaggtgaaacttttgagaaaaaaagctaagagacatatagaatcaatacaaaagatccaacatataactcaagaaagatagaacatttaaaaagagatagaaatttcaaggaaataaaagacatggaattcccagtgttgaaggacacatcacaattttcctgcattcttacatagcttctaattggcctttttacttggatatttgcttcttacatttatttatcaatataggagtaaccctttaaaaaatgtaatacagagcagtaaacatctttgctcaacccccgaaatgctcccctgaaatagaggaaaagtgagagtcctcactggatctgtccccaccccaatccccagccccaatcacatctctgacctcatcttttaacactttcacctttgcttactccagtctcaaagatcaggtacacttcccaggtaggatttcctcctctaattctgccttctgcttcaaactctatttctctagatatctgtgtactgaacttccttatgtacctcaaatattgtttaaatgaagtctaactgatcacactacttaaaattataacctacaaccagcaagaatggtcttcctcaccctgctttatgttttcatttccccatagctttcttaaatgtgatgtaatttatttacttactgtgcccaatccttattatttgtctctgttcaatgggatataagcttcaggaggtcaggaacatttgtagttttcactcattattttattccatgagcttggaacagtgcctgatacatagaaggtgccctgtaactatttattgaatgagtagataaacatacaaataaatgaagaagttcttcatgagtggcacacaactttgaagtactggaattataaaaaagaaaatgtaatctttgcacaccactcattgtaatgagcaatgttcatagtccaaataataattatggtattacagacttttcaaattatagaatcaggcaattgaacaaagcatgaatgacataattacagctatacaaggaggtgaaagatctctacaagaactataaaatactgttgaaagaaaccacagatgacacaaacaaatggaaaaacattccatgctcatgggtagggagaatcaatatcataaaatggccatactgcccaaagcaatctacagattcaacattattcctattgaaccactaatgtcatttttcacagaattacaaaaaaactgttctaaaatttgtatggaatcaaaagagagcctgaatagccaaagcaatcctaagcaaaaagaacaaagcagaaaacatcacattactaaactttatactacaaggctacagtaaccaaagcagcatgctactggtacaaaaacagacacaattgaaacaatagagaagccagaaataaaggtgagcatctacaaccatttgaacatcaaaaaaattgacaaaaataagcaatggggaaaggattccctattcaataaatggtgctgggataactgtctatccgtatacagaagaatgaaactggattcctagccatcaccatatacaaaaattaactcaagatggattaacaacttaaatgtaagacctaaacctatgaaaatcctagaagaaacctaggaaatacctttctgaatgttagccttggcaaataatttatgactaagtcctcaaaagcacttgcaacaaaaataaaaatggtcaagtggaatctaattaaatgaaagaggttctgcacagcaaaataaattaccaacagataacctacagaatggagtaaaatattcaaaaattatgcatccaacaaaggtctaatatctagaatttctaaggaacttgaacaattgaacaagtggagaacaaccccattaaaatgcgggcaaaggacatgaagagaaacttctcaaaagaagatagtcaagcaaaaacatacatatgaaaaaaatgctcaacatcactaatcgtcagagaaatgcaaattaaaaccacaataaaataccatctcacataactttattatgtgtctcacatgactttattaaaaagtcgaaaactgatagatggtggtgaggatgtagagaaaagggaacacttgaatactgttgaagaggatgtaaattagtacagccaatatggaaactcgattggagattcctcagagaactaaaaatagaactataatttgacccagcaatcctattattgggtacatgcccaaaggaaaataaatcctaccaaaaagacatgtgcactcatatgttcatcgcagcactattcacaatagcaaagacattgaattaacctaaatgccaataaacaatggattggatgaagaacatatggttcatatatacatcatggaatattatgtagccataaaaaagaatgaaatcatatcttttgcagcaacgtagatgcagctggaggctattatcctaagctaattaacacagtaacagaaaaccaataccacatgctttcacttataagtgggagccaggcacactggggacacatggacataaagatggggaaaatagacactggagcctccaaagttggggagggagggagagagggagtaaagggttgaaaaactatctactgggtaccatactaactacctgggtgatgggatcagtcatactctgaacttcagcatcacctagtatatgcatgtaacatatctgcacatgtcctgaacctaaaagttgaaattttaaaacatgtataattatgattataaaataaccttgcagagtaaaaatcaaggtacacttgtaagatttggaaggtagaaagtggtcagaaaaggattaaaaatggcaagacagctaccaggtcctaccacacaaattaggagtccagatgaatcctgttctcatagaaagctgatggttaacaaaatggttactaaagtattatttttaaagttatagaagtagctggtaaaggaactgaaaaacattggtataaatttatggggagtcaaaaggcaatgactgcagatgaaaaattatgaaatagaaagatatttagttaaatctaggtaactaagagaacagctaaacataaaagtagctaaagtagtcatatcttggaatttagacagggacagggaaggtgtgagtgggagaggacatttttaaaaaatatatccttacatattattagatttttctttagtgcacaatatttctttgatttttttaaaaaaattatttgaaaagtaaatggcttagagaatgcttaataattactaacctaactaacaaacattgtttttcttttgcatgtgaaaaaaccctttgattaaattattttatgaattatgtagaggtatttttaggtgaattataataaattataactatgaaattaaaacacaaaaataatgttaaatttagaatgcttgctactagtcatttatcctgagatgaaagcaagcatgacagatttaaataatactgcagatttttttttccacagtccagtggttgaagctacggtctccttaaggcagggcaatgacagacatggaaaaactgtagcttgacatttattcatttttataattcatttattaatttattcaccaaatgtatgttgtatgccagatattttccaggcactgtgcaacattttatgagagaactcacacaaccatgttctcatttctaagtaatttatcacatctaaagccataggtcaggaatttaaaaagaaatagctactgcatataatcatttgtttcatgaaatataaacatgaagatactattaataatacattaatttatataccgttttatagttgataaggcatattcatgtatattatttttcttcacaatggcctggtgtagttggtggtattcaatttctaatttacaggagaggaaatggactcagagaagtcaagggacttgcccaaggtcaccatgtttggtagaagcaaaacaaatagccacattcattgtactttccacaacacttcagctacttttgtttcattctgatgcttgggctcgacatgttcatctcatcctggttattctgtaggcctagttcaagtgctcctccctggaagttacactgattcagctcaggctgtaataatttttttttctttttttcttttttttttttttgagacgagtctcgctctgtcacccaggctggagtgcagtggcgctatctcggctcactgcaacctccacatgctgggttcacgccattctcctgcctcagcctcccaagtagctgggactacaggcgcccaccaccacgcccggctaattttgttttttgtatttttagtagagacagggtttcaccatgttagccgggatgatctcgatctcctgacctcgtggtctgcccgcctcagcctcccgaagtgctgggattacaggcgtgagccactgtgcccggcataattgtttgtttaatctggattctaaaccttttttttaaaatgcatataagtcttctaaatcttgtgtgcatgtatgcatacatgtatgcacatgtgctcatgtgtatgtgtgtgtgtgtatacaatagcactcattcagtttcagtgtgcttatgcactttcctggactgaaagccccccgagatcagggactggaaagactcaatcagtgatgctctttagcttgtatgttcccttatgaagctatgtttattatataggcttggaatggaagaactctggcttctaattctgactgattgaaaccttaaggctggattttctataacttcagacccaaccagatgacatttttttctatacctctacacgtcatagagagatatgtattaggaatcacagacttatataatgtcttcgctcctacttccttccctgcaatatgttggcaaagcctaggggcagttctggagcccggctgctcgcattcaaattccatctctggcatttaccacttgtgaggccttcagttatgaagatattttctccatgcctcaatgcctgcatctgtaaaatattaacagtatatacctcataggatttacttaaatgagttaagaaaagaatttagaacaggctttgaaatgatatgacaataaataaattataactatttttatcttcctcacaggtgatctagatatttgaattagatagtgtgagtgaacgtgaattgaaagtactcatactatttatattaattatattatattatattatataacaacaattgaaatttaaagttagaaagtgctaaatgacttcatgggaagcattacctgaaaatatttaaatgttatgcagtagagactgactgatactgtgaagttctcggcatacttctctattcaattttcatccatatctgattcattctactagagaattctgagaatgaaaacaaggaaaaatttgctgttgaatttctggagcttctgaacatttctcattatacagtctccagttcaattcttcaccattttcacctaacttcaacagcagcagcagcagcagccctgtgctcagtgacaggaaaatagcatgtttatttagatgattcaaaagctagcttctattccttacctttatttgtataatttctaacttcacactattttgaccattaactagttttagatcatttataaaactctaatttatgcactgtgagtattccagagaactcctttaatagccacttacattcaatttcctgtggcctagacattagctacctgaatgagaagggatcagttttagccaattaaagctcatgaagggaaaacagacaccacccgtaagcaaaacaagaactgtggattaaaaatagaaaatgaatggtgtacctgcaaatcagtaagtgttgtgctttccataaacatttaattatatgtttaaaaagtacattttactaaataagttactaattttaaattttaaaatagttaataactgtaactattttatatcactctcttttgttaaacagcttagagttaaatttatactccacatttgaccagcgtgcagtgtttggggcattcatttttatgtttgaatctcagtgctatttaataaccaaatatttttccttcctttgcctggcagtcctcacctatttcaaatttaaagaaaatctgtttaccagcatatctttgtagtccaaattatatatttcaaaataagcagggagggtaattagatggataaatagaaggtgagtgcatttctgaggagtttgtgaagccgaaaagggtacaggtagggaatgaaatgagcattccagggaatagtagtatacagacatggggggtctaagaaagcacttttcctctcacctccatcctcctttgggtggtattttggcagcctaagaatttagaataaccaaataactaaacaaaagttaacagtattatggtagaagcaaataatttaaataaacaaatacatatatacctacataaaagattgggaagaaataggtcaatattccacaaaagaggaagagggaatagtaggaatagagggaatgagggtattttttttttttgccgctggctttataataaatgtattatattctcagtagatactttgatacttaaatctttttaggtgaagtatttggggatgagtttaccttacacaaatttctttatctgtttatagataaaggattttcttttactttgggggggtttcttggcaacatttgagggtagtgaccatgtgtcacttatattcccatagcctagcataaggcctggcttatagtgagaagtctagaaagaattttgtgtaaaaggctaaagatggagtagaaatgaaagatgggcttattgtgaatgttaatttttaaggattacttaaaaactatcaacagaagttttctaaggagaaatataaatttatgaggtatcaaaaagaatacaacagatcctatacttttctttatcttttactttatatatacccatttactcttatcccacatacccactcaccccacaccatatttgtaacttagaagctcagtgaaaactaacttcaaatggtagaaggaatacatttagagtcaaaaataaatatctctttcacctctgcctgacccccagttctctagagaaaaacacctaaagatgttttatacatctaccagcatatggatttgtaacattactatcttctccagttaatagtgaataatattaatcatgcagtttaacctagtattttctcaaacagctcacggcagaatcaactggaaggcataaaatattctcaaatgctatactttgacattcaacctcagtaagtctctagacggcgaaaaccatgcatgtttaaaaggaccaccaggttttttttgtttttgtttttgttttctttttgagatggagtttcactcttgttgcccaggctggagtctcatggtgcaatctcggctcactgcagcctctgtctcctgggttcaagtgattcttgttgcttcagcttcccgagtagctgggattacaggcatgtaccaccacgccctgctaattttttgtatttttagtagagatggggttttgccgtattggccaggctggactcaaactcctggcctcaggtgatccacccacctcagcctcccaatgtgttaggattacaggggtgagccaccacgtccagcttgccaggcattcctgattacagtttgagaacaaccgtttttactaactccttggtttacttttattaaaactatccacatatacaaagttgaatttacttagcagttgttaaaagagaattatttggcctggactatattacagagacttatcatagaaatgcataaaatttatatagtagttccaattttttttttttttttttttttttttttgagactgagtctcgccctgtcgcccaggctggagtgcagtggcgcgatctcagctcactgcaagctccgcttcgtgggttcacgccattctcctgcctcagcctcccgagtagctgggactacaggcacccgccaccatgcccggctaattttttgtgtatttagtagagatggggtttcaccatgttagccaggatggtcttgatctcctgacctcgtgatccgcccatctcggcctcccaaagtgctgggattacaggcatgagccaccgtgcctggccagtagttccaaatttaaaatgacacagatatgaatgatataagaaaaattctagatttttatagaaaattactgctttagagcattttgcccttcagggtcagaatagttcaggactaaatttggttaaaagaataaacactagttaatataagcaacattcagattaattctgatctcttacattgaatccaagattttaagctgccaaatataatttgacaagtctctttaattagtttatgaagttaagctgttgccaagcttctcataggaatcataattcagcccattctctctcatttttctactgaaaaaataaataagcaattcatggaattaagcctcaccttaaccataaaatttaaatctaaacacagctttcataataatgaggatgaatgagaattaaacttatttaaagactttgccagtgcactacctggaaatacagagtaaaccatgatatgatacattctcatagcaaagtggattccagtacggtcaagaaaagttaatccatggtgaagtatcctgccttgcccttgtgttcatccctcatttgaaatgaaaataaatgccgttcaggaaaggcccttgttatcatcaacctctcccgtgttgttactgctgctagaaaagctatttctctagttttcagctggactaggaaaacatagagtttttttttcttttataccaaccatttgtaattgctatttttattgtgtatcaatttattagaaatgacacaacacaggaacagcccaaatggaaaggatgcataaagcgaaggggagggacagaccacaaagctcccatgcagctctacgtgttcaccagcccagaagctctacgcattgctttaaaaataacatcattgtctgtaatacaactccacaggaatacaagacaaatgtgcaacaaatataaagagatcaatagactgattctagaagtcactagtacagtttcatgtctatatgtaacccatgtataaaacatggtatggaaaacattatatgtatatgaaatatttgcttattaaggtgaattctgagcccatggatatctttcttacttgaagtgtgttccttctgatggtgatggcaactttctctgtaggagtaactgaacaacatgcattccagtggcaaggagtctcaggcagaggatgctttctatgaggatcagcctctctaacctcttttatgtttggaagacagtagcttcgtggctgcattgctgatacctacagtagaccccagcagactgactgccagaccaggagcctatgctgtctcattgtgaaaaaaaaatttgagcatttaaataacctatggtcagtaggatatacatttgagcaatggctttttcagtactgttacttgaaaattatggaaaataggacctgctgagtcaatttcagaggattttcataagaattaaattaagtaatgaatgtgtgagagctttcaaaattatagcacactttaaaaaaatgcaaattatcattattgttggaagaccacttgatggaggcatgaaaggatgagaagtttccctggatacctcaaaataataagagccatcatggcaaacccacagccaacatcataatgaatggacaaaagctagaagcattcccccttgaaaactagcacaagaaaagaatgttctctgtcatcactcctattcaacatagaattgaaaatcttagtcagagctatcaggcaagagaaagaaataaagggcatccgaatagaaagagaggaagtcaaactatccctgtttgcagaccacatgattctatatctagaaaatcccatagtctcaaccccaaagctcattaagctgataaacaactttgggaaagtttcagcatataaaatcaatgtacaaaaatcactagcattcttacacaccaacaacatccaagctgagagccaaatcaggaatgcaatctcattcacaattgccacagaatgaataaaagacctaggaatacaggcagccagggaggtgaaagatatctacaaggagaactacgaaatgctgctcaaagaaatcacagatgacacaaacaaatagaaaaacattcctactaggaagaatcaatattgttaaagtagccatactggccgaagcaatttatagattcaatgctattcctatcaaactaccaaggatattcttcacagatgagaaaaaactattttgaaattcatatgaaaccaaagaatagcccaggaaatcctaagcaaaaagagcaaagctggaggcatagactacccaacttcaaactatactatggggctacagaaaccaaaacagcatggtaatggtacaaaacagatatttagaccaacttaatagaatagagagtccagaaataagactgcccacacacctacaaccatctgatcttggacaaagctgacaaaaacaggcagtgcagaaaggactccttattcaaaaaatggtgctgggataactggctagccatgtgcagaagattgaaactggacaccttccttacaccatacacaaaaattaactcaagatggatcaaagacttaaagaaaaaaccccagactataaaaaccctggaagaaaacctaggcaataccattttggacatatgaacgggcaaagatttcatgataaagacatcaaaagcaattgcgacaaaagcaaatgggatctaactaaactaaacagcatctgcatagcaaaacaaactaagaacagaataaacagataacctacagaaggggagaaaatttttccaaactctgcatctgactaagctctaatatccaccatctacaaggaacttaagcaaatctacaagaaaaaataaaacaaacaaccccatataaaaataggcaaaggacatgaacagacacttttccaaacaagacatacatgtagccaacacacttatttaaaaaagcttaacatcactgattattagagaaatgaaaatcaaaaccccaacgagatactgtcttgcaccagtcagaatagctattattaaaaactcaaaaaataacaggtgctgctgaggttgaggagaaaaagaaatgcttatacactattgggtgggagtgtaaattagtgcaagtattatggaaagcagtgtgacaattcctcaaagaagtaagaggagaactgtcattcaactcagcaattccattactgggtaaatactcaaaggaatataaattgttctattgtaaagatagatgcacgtgtatgttcattgcaacactattcacaatagcaaagacatggaatcaacctaaatgcccatcaatggtatactagataaagtaactatggtacatatacaccatggaatactatgcagccataaaaagaatgagataatttcctttgcaagaacatggatggggctagaggccattatccttagcaaactcattcagaaacagaaagccaaatccagcatgttctcacttacaagtggaagttaaatgaggagaacacatggacttatagaggggcacaacagacactggcgcctactggagggtggaggttgggaggagggtgaggaccaggaaaaatagttaatgggtactaggcttagtacctgggtgacaaggaatctgtacaacaaatctccatgacacaagtttatctataataacaaatctgtacatgtatccctgaacttaaaagtttaaaaaaatctaccaatggatgtccaaattagtatgcgaaagtttgaggagaaacaaaataatttcatagtctcaaaatatctccttcaagatatttactaattataaaaggaaaaagtgtaactttacaggggagaaagccagcagacaccaccttaaccaaatgatcaaggttaattatcaccagtaataagacatactgacatgatgtactccctgatatataggctgagaaggttatatcactgtagcatgcctgccaaaaatgcataacttcaatccaataatgagaaaacatcaatccaaccccaactggcagttattctgcaatataactgactagtattctttaaaagtggcaaggtcatgaaagacaagaaaagactgagggaatgtcatagattggaggagccaaaggagatatggcagctaaatataaggtgagatccaattagtaaaagaactggtgaagttccaattaggcctgtttaatagtaattaatagcagtaataataacattaatagcacaaatgttaatttcatggttttgatcactgtactatggttatgtaagatgttaccttaacattcagggaagccaagcaatgtgtagatgagtgctctctgcatgttttttctaactcttctgtaagtcaaaatttgtatcaaaataaaaagtcaaaaactaacaaaacaaacaaataaaatgaaggatgagcaggttctttgctgtgttctctctcttcgatgttgacaataccttgcatctcatcactaaatatagattcctggaatcagcctctctctcactccccacatcaactagcatttgcatttgttcctttttttttctaaataattcttgaatctgtactttctggtctttctctattgtcatcctgatccagattctcataaaatagcttacaactgggatacctaactccattcttatatccctgaaatctgtcctgtctaaatagctgaaagaatatataataaaaatgaataattgtggccatttccttcttcaatgcatttcagtttcctgctcatgtcacgcttctcagcataacaaataacatcctctacagtgtgacccttccctgttctcaagctcctttgtcacattctctgtcttccacttatgctctggcaatacctaactacttcttcatctctaccatgacatgctattttgtatctctgagtctttttgtcacgctgtctcactgacctagagagcactttccatcacctcctccgtcaattcttagaggtagtaaacatcatccaggtagtttttcttgatgacatccgctctcaacccatttcacattctccagggcttctataaaactgcaggtttatttatattcatgaactttctatatttttaaaaatttattaatttatgtgtctatctcttctagatggggaagttcttgaaagcaaggtctatgtcatagtatgttcctatatgccagacacatagaaaaactcaataaatacttataaagcatgagaaagaaagtggtgggaaaagggatatgataaaccttatataaatgtaaagaaaaagaaatgactgagagatggaagaagcaagtaatttgtaaaatgaggttaaaatgaagggaaaggataattgatgagatttagataaagagggtcatatctaaaagataaatgttgaatggagaaatagaagtagtattaaaaaaaaatgagaatacagccaggcgcagcagctcatgcctctaatcccagcactttgggaggccgaggcgggtggatcacttgacgtcaggagttcgagaccagcctgcccaatatggtgaaatcttgtctctagtagaaataaaaaaattagccaggtgtggtggtgcatgcctgtaatcacagttacatggcaggctgaggcaagagaattgcttgaacccaggaggcggaggttgcagtgagccgagatcgctctattgtactccagcctgggtgactgagcgagactctgtctcaaaaaaaaaaaaaaaaaaaaaaaaaaaaaagaaaataaaaataatgagaataagtggattggagaacaggactattagagaataagataagaggagtagactatggaaataaaaggatgaaattgaccatctaattacattgaggccagagaagtagaagaaaataaaacagaaggtgtgttgacaagtaatctccatggaaagcagtaaacataaggtagctatccgggtaatgaaaaaaaaaaaaaaaaaaaagagagagagagaagagaaatctcagagtagttacaaaaagataaatgatttaatggcaatgctaagaaaaggacatgtgggggaaaaacacgaaaaagaaagtacaaaaatgtgacttggaagtatattggaagattgtcttaaatattgaacgctttgaaataatggatgcacattgaaccccaaattagcaattccactggcaatgtagtcattaagagagcactgtggagttactcatgtctttttttaggttaattttattatactttgtagctatattaaatgagttttgcccttatccagagcaattgcaattcagtatctgtcttttgctataacaaatgagccagatttgaaatatatactgtccttttctgtcaatgcactttaaaagactaccagtccccactgacctcttacagtgtatgattatacgaagagaaaaaatggaagaaaagcaccatgggcaaatgtcctgaatgctgtcagagcaggtgacacttatgtgatatgactcaacttgacatctctcagtattccattacaaatctgagagattatgttttcacctgtggaccgcagttgcctcaggtgcccagatactatccctgttcttcagcagaggtcagccaatactcactgttaaacaccagtcaaacacatggcagccagctggcaaactgacgctcctgaaatcttgaatctgccttttctaatattattttgtaggaggcatacctcaagggacatcaagatgttagttaattagggtgtgcctaaaaatgtaataggactatgctgtgtgtgtgtgtgtgtgtgtgtgtgtgtgtgtgtgtgtttgtgtgtgtctgtgtttgagatggagtctcactatgtcacccaagctagagtgcagtggtgcgatattggctcactgcaacctcccctcccaggttcaagcgattctactgactcagcctcccaagtagttgggactataggtgcatgccaccatgcccggctaattgcatctttagtacagacggagtttcgccatgtttgccaggctggcctcaaacttgtgaccttaggtgatctaccgccttggcctcccaaggtgctgggattacaggcatgagccactgtgcccggccttccattttttatccagaaaaatcaaaagcaaaccaaacaaatgtttatatttatccagaaaaatcaaaagcaaatcaaacaaatgcttatatttatttaaaacaacaccctttaatgtttgtttatcttgatttttttttttttagaaatttcttctcatttctggcaatgcagaatataatctcctcctctccgtacatgacccacatcactgaaactgcactttgccttttggctctcttctaatattatcccgccatgaattagctatctatgatgactattctatgctgtttttttggccaaaatgtttttatcctttttctgtcatcagctgttgactataaactttttcatcgtccagctatggcattatgtgggtttgccccatattctaagttttgtgggattctgtaaagaattttaaattccacaccagctctgcgctatggtttttctcctgtctgtttacattctgttttagagaatttgaagtaatttgaaaataacaatcaccatttattgtgtcgtcactctgtaccatacattttatatgcattattatataatcatcacagcaaacctatcatggatcttctttcctcattttaataatgacaaaattggaattgagaaagagtaattgatttgtccataccacagttagcctctaatgacaatctcaggattcaatagtggtgtgtgttggattccaaagccaacactcaatgagaaacactagaaaaacaaacagtagcactctggcattttccactatgcatggtacttttatatatgccagggaagattcaatgacagagataatctgatgggaggagaaacaacaacaactacaaatattacacacttagagttgctggggacattgttcatcacaattagagcagattttagagagcatcctatttactctgaacctaaagaaacaactcaaaaaccaaactactctatactgggaggaaatgacatttgcttccaatagacactcctgccacagtgctaggttttatctacctaaaccttaaaatattgtgtctcttttgctttctgttcaaataacataccctgaaaacttattgtgagactacatcctctgccccttaattgtccttaaaatgtagaacataggtgaaaacagactaaacaaaaatgttactgattgttataacattaaaatattctatgtagaaatatatttatttactttgattttggtatctctagtggcatcctaatggaaacttctttttaataatagaaggtgctctaactcctgcttaaaagtggaataaaaaaagaaagtgttcattgctttaaccctgttgctactatgtatttccaccctagagcagataagaatattgtggtagaaattcaaagctaaatttcctttttggttatattgaagaactactgaaaatatgagtattcctttttttcttctaggctactaagctctaatctggaaacaaaaccaaccaaccaaacaaataaaactgaggaaactacagctgtattcttcatagataagggatttcatggaacacctatacaatattctcattgccaggcctataatgatgatgttttatcttttattaagtttatctaagaggtatgtgtaatgtacaagaaagttttaaagagggagtggccaagatggccgactagatgcagctggtgtgcatggctgtcagggagaagaatgaaaggggtgagtaatacaatgccctcaactgaaacatccagttactcactggatgattacaactaatcaaggaaacaacttgacccacagagaacaaagaagggcaagacaggacaactgcccacctgggaacaacacagagcaaggagaacctcccccacccagagaagtggtgagtgaatgagctgccccaggaaaccatgcttctgcacagatctttgtaaccttcaggtcaggagatctccttgtgaacccattgtaccagggccttcagtctgacagacagagacacttggagtcttggaagagcagctgctcagccatatgtggagaccctggagccttagatacttgggctttccagcaaaagtagctgcaggtccagcaaagtgggaggttagacccccatacatacaatataccagaatctctgagacacagctaaggaagtgttaagagggaaattcatagcactaaatggccacatcaaaatttagaaaaatcttaaattaacaacctaatctcacaactgaaaaaattagagaagcaaaaacagataaaccccaaagctagcagaagataagaaataactaatatcagaagttaaatgaaggaaatcaagacacgcaaaaaattcaaaagatcaatgaatacaggaattggttttttgaaaaaaataataagatagataggctattatacctagacaaataaggaagaaaagagagaatatccaaataaacacaactataagtgataaggtaatgttattattggccccacagaaataaaaagaaccaaaaagaaccatcagaaactactacaaacatctctaggcacacaaactagaaaatctagaagagatgggtaaattcttggacacatacaccctcccaagactgacccagaaagaaattgattacctgaacaggtcaacaaggagctacaaaattaactcggtaataaatagcctaccaaccaaaaaaagcccaggacctgatggaaacacagccgaattctactagatgtacaaagaagagctggtaccattcctactgaaactattctataaaatggaggaggagggactcttccctaactccttctataaggccagcatcatcttgacaccaaatcctggcagagacccacacacaaaagaaaacttcaggccaatgtccttgatgaacattgatgaaaaaatcctcaacaaaatacttgcaaactcagttcagcagcatgtcgaaagactaatccactatgattaagtaggcttcatccctgggatgcaaggttggttcaacacacacaaatcaataaatgtgattcatcacataaacggaactaaaaacaaaaaccacatgaatatctcaatagatgaagaaaaggcttttgataaaattcaacaccctttcatgttaaaaactctccataaaccagatattgaaggaacctacctcaaaataataagagccatctatgacaaatccatagccaacattttactaaatgggcaaaagctggaagcattccccttgaaaaccagcacaagacaaatatgccctctctcatctcttctattcaaaatagtattgaaagtcatacccagagctatctggcaagagagacaaataaagggcacccaaataggaagagaggaagtcaaactatttctatttgtagactacatgattctatatctagaaaaccccaaagtgtcagcccaaaatctcctccagctgataccttcggcaaagttgcagtatataaaatcaatgtacaaaaatcgctagcattcctatacacccacaatagccaaaccgagacccaaatcagcaaggcaatctcattcacaattgccacaaaaagaataaaatacctaggaatacagctaaccagggaggtgaaagatctctacaaggagaattacaaaagctgcttaaagaaatcagagaagacacaacaaatggaaaaacatcccatgcttgtggacagaaagaatcaacattattaaaatggttataccatccaaggcaatttacagattcaatgctgttcctattaaactaccaagcacattcttcacagaactagaaaaaaaactattttaaaatttatatggaaccaaaaagagtctgaatagccaaggcaatcctaagcaaaaagagcaaagctggaggcatgatgttacctgacttcaaactatactacaaggctacattaatcaaaaatgcatggtactggtacagaaaccgacaaatagaccaatggaccagaatagagagcccagaaataaagctgcacatctacaaccatctgatctttgacaaagctgacaaaaataagcaatgggggaatgactccctattcaatgaatggtgctgtgataacaggctagccaggttcagaagattgaagccggacctcttccttataccacatacaaaaatcaactcaaggctcagcgcggtggctcacgcctataatcccagcactttgggaggctgagacgggcggatcacgaggtcaggagatcaagaccatcctggctaacacggcgaaaccccatctctactaaaaatacaaaaaaattagccaggcgtgctggtgggtgcctgtagtcccagctactcgggaggctgaagcaggagaatggcatgaacctgggaggcagagcttgcagtgagccaagatcgtgccactgcactccagtctgggcggcagagcgagactccatctcaaaaaaaacagaaaacaaaaatcaactcaagatggattaaagacttaaatgtaaaacccaaaaattataaaaaccctggaagaaaacctaggcaataccattctggacatacaaacaggcaaagatttcatgatgaagacaccaaaagcaattgcaacaaaagcaaaaattgacaagtgggaactaattaaaattaagatattctacacagcaaaaaaaaactcttaacagggtaaacaaacaacctaaagaatggcagaaaacttttgcaaactatacatctgacaaaggtccaatatccagcatctataaggaacttaaacaaatttacaagagaaaaacaacctcattaaaaagtgggcaaaagatatgaacagacacttctcaaaagaagacacatatctggccaataagcatatgaaaacaagtacaacatcactgatcattagagaaatgcaaattgaaaccacaatgagatacaatctcataccagttagaatagctattattaaaaagtcaaaaaataacagatgcttgcaaggttgcagaaaaaagggaacacttatacacagttagtgggagtgtaaattagttcaaccattgtggaaagcagtatggcaattcctccaagagctaaaagcaaaactaccattcggctcagcaatcctattactgggtaaatacccagaggaatagaaatcattctatcataaagacacatgcacacaaatgttcattgcagcactatttacagtcgcaaagacatggcatggaatcaacctaaatgcccatcagtgacagactggatagagaaaatgtggtacatacataatacgtcatactatgaagcaataaaaaagaatgagagcatgtcttttatgggaacatggatggagctggaggttattatccttagcaaactgatgcagaaacagaaaaccaaataccacatgttcttacttataagtgggagttaaatggtaagaacttttgagcacaaagaagaaaacaaaatacattagcatctacttgagggggaagggtgggaggaggagaggagcagaaaagataactattgggtactgggcttaatacctgggtgatgaaataatacgtacaacaaacccgtgtaaatgtatttgcctatgtaacaaaccttcacttttacacccaaacttaaaataaaagatttttaaggccaaaaaagtgtataggaaccacacacacaaaaaagagagaaatgtttaacaatttatgaatggccaaattagtatttggtattacaatatattatatttcaaaataaagactaatatctaacctgtagattcattttcttctcttttcacatagcctaccctgagaagctctttggctctcaaagctttaataattatgcctctgagaataattcccaaatttggatgtataatgaatattctcctgaaccctagctgctcttttcaacaggaagtcagatattttcacatgctcatttttttctgaaatccaaaatatctgattttgaactctctatcatcctcagaattatctttttcctttaattcacatttcagtaaaaaaaaaaatagcaccaatatttttctcgattatccatgcacaacacattagagtcattttaaaatacttgacatcctcatgcattttttttttttcctttagcaagagagggagtcttgctctgctgcccaggctggagtgcagtggtagatcatagcttactttagcctcaagctcctgggcttgatcaagtgatcatcctgcctcagcctcttcactagctgggacgacaggctagggccactatgtccggctccttagatttttataatattaagttttgattccaatcctttcatgatgtgttcccaattcacaccatgttatctcctgcttcttttcttctaactgtgccctacattccatattccttctctggggaatgctgcttccactttcccacctaggaagctactcatcctatcagattgagctcaaatagttcttcctttatgaattcttcattaatccacaggacataggctgctcacttcttttctgggttcccatttcttactttttttttttaagagatggggtcttgttctttcgcccagatgggagtacagtggtggaattagagctcactgcagcctggaacttctgggctcaagtgatcctctcgcctaagcctcctgagtagctaggactacaggtgtgggctaccatgcccagctaatatttcctttttatttttgtggtgggagggaaaagtgagggtgtggggtctctctttgttgcccagactggtcttgagcccttggcctcaagcatcctcccatcttagcctcccaaagtgctgagaatagaggcctgagccactgcacccaacctggattcttatttattacatttattattcctctaatttctgtaagtcctcaaggacagaaattgagtccaaattcagattttgttttttacgtgaagaccataatcctgtgtataatacatgatcatgaaatattttttaaatgcatgcatgaatgaatgagcacatgaatgaacaaataagtgaatgaatctttgacttctttattcagtttcctggacttcgttccactgccttttgtttttccttcaacctacttacttgcaaaataattccccaggtaattttagtatctgcttaaactgaaaagccaaggctttcatgaaatatcttgtatgaaataattcagcttatttttctagttcacaatatgttggcaaacttcaaaaacatttagtgatttccaaacagttacattaagctatctgaagatagttttgaatgaattctctacaagtgaggataaattgtaataaacaaaaatacttttaatgttcaaaggacaaaatattatatttagtgttctcattcctacaaatcacttgtttccacttttattcctatttttcttgcagactatcaattctatcagttcagaaacatgatagaaccctttcctaacatcttaggtctcccttgtgggatataagaaatattctcctgcagataataattagattgataggtttcagggtgttttcctaagggaaactcagaagttatttcttctaaaacatttaacagcccaaaatatctaattcaaaattcttaatgttttggccccacaataatgaaattgtgagtctttctttttttgttattatagatagaaaaaaatttgaagccagtaaaaattccataaattggcacatgatatgaatgctatattgatgggaaagtctagataagtaaatataatgatttgaaagcacagagtaagctcccatggagaaagtatactaaagggccattttgccattatatgaacaaacagaaggcattcttacattttaagtgccatgataattacaatgagaatgataactaatatttgtatagttgcacccaattgaccagtgaaatcatgcagaaaggacctggctaatgagcctgtaacagccaaggtataggcactgagataaattcttatccataattaggaaatgtggtcacaaaatacaaatatcaaagattgcctttgaggtgagtacttacttgaaatgaaggatggggaaggcagaggaaaatatctgtactcaaggtaaagcattcgaggtcaaagacttagagaaagtaaaagaaatgtttactagagagggtcaagttctctctcagtgtgtgcatgttgtacgttgtttaaattaaaagtgtcttaagcaattacatttcagagtagcaaaaatttactgtctctgtttctctgaggatccctccctctataacatttcctagtacaaatacctgagcactagcgaaaaatgggtgagttccacaatctgaagaccaaacaaaggacaaaaaaagtctgtggtaggattgaggcagggttgagattttgtgtcatatggacatgagagacggagagatcaaaattttcatgagagagtagttaaaatatgggcaaagcattctttctgaataagaaaataaataaagaattaagtatctaaataagtttggagagaatgacaaaatctaaaatgagacatgacgaggttgaggataaggtattacaattttttttggagagagacagaagttgaaatttaaaatttcatttctgaaaaaaattctatgcatagaatatattcattaaagtactgtagaagaccaaataaatccaaactactctaactaagagttcttgaaacagacagcgagaataaggctgacaaaaatagttatattcacaaaggtgcatccattgaactatcttactgtgtttttttaaaccaggtacttttaaactcattggactattggtttagaatacacattatcagagatcacctttttctataaaaataactattttatttttgtttttaaatatcagattaattcaatattgtttttataactacctaccaatcaccatctcaaagaaatgatattcagttaaatttcttttcttaggatgtttttcacacatttttacatttttaattttattttttaaactttgttttgtttatttttaaattttgtgggtacatagtagatgtgtatatttatggcatacatgacatattttcatatgggcatgcgatgtgaaataaacgcatcatggagcatggggtatccatcctttgagttacaaacaatccaattatactcttcattttaaaatgtacaattaagttattattgactatagtcaccctattgtgctatcaaatagtaggtcttattcattctttctatttttgtacccattaaccatctccaactcccttaatttttaattattatgaatacataatagttgtacacattatgaggtacatgtgatattttgatacaagcatataacatataatgattaaataagggtggctgtggtatctaatatttatcttttttgtgttaggaatattttaattctactcctttagttattttgaaatgtacaataaattattgtttactatagtttccctattgtgctaccaaatgccagatcttattccttttacccaactatatgtttgtacccattaaccacatctcatttttctcttaactttcatggtttattattattattgttatcgttgttgccacctattaatgagaacatgtgatatttgtctttctgtgcctggcttatttcacttaacgtaatatcttacatttctatccatgttgttgcaaatgacaggatttcattctttttattgttgaataatattccattgtgtatatgtaccacaatttctttatccatttatcctttgatggatacataattttattccatttcttggctattgtgaataatgctgcaataaaagtgggagtgcaaatatctccttgatatgctgatttccttccctttggatgtatatccagcagtgggattgatggatcacatggaagttctaattttagattttgagtaacctctatactgttctccacagtggctgcactaatttgtattcacgccaatagtgtacaagagtttccctttttccacattctcatcagcatttgttactgcttgtcttttggataaaagccattttaactggggtgaggtgacctcaaggtagttttaatttgcatttctctgataattagtgatatggagcatcttttcatataccagtttgccatttgtatgtatccttttgagaaatgtctatgcagatcttttgtacatttttgattggattgttcttttcctattgagttgttcaagctgcttataaattctggctattaatctcttgtcagatgggtcattggcaaatatttttttccatcccgtgggttggcttttcactttgttgatgatttcctttgctgtgcagaagaagctttttactttgatgtgatcccatttgtccatttattttctttggttgcctgtgcttttgaggtcttactcaagaaatctttactcagaccaatgtcctgaagtttttccccaatgttttcttctagtagtttcacagtttgcagtcttagctttaagtctttaattcatttaggtttttgtatatagtgagagatagaggtctagtttcattcttctgcaaatggatatccagctttcccagcaccatttattgaagatactctccttttcccaatgtattttcttggcatttttatccaaaatgagttgactataaatgagtgggtttatttctgggttctctattcttttccattggtctgtgtgtctgtttttatgccagtatcatgctgtttggggtactatagctttgtagtataaatttaagtcaggtaatgtgacgtctccagcttcagtctttttctcaggattgctttggctattatgggtcttttgtggttccatatacattttaggattactttttctgtttctgtgaagaatgtcattggtattttgacacagattgcatggaatttgtagactgctttgggtagtatgaacattttaacaatattgattcttctcatccatgaacatgaaatatatggccatttttgtgtccccttcaatttctttcatcaatgttttacagttttattgtacagatatttcacttctttggttaattcctgggtattttattttatttgtggctattgtaatgggattactttcttggtttctttttttcagactgcttgctgttgttatatagaaatgctactggtttttatacattaattttgtagcctgaaactttactgaatttatcagatccagtaacttttgggatagtctttagtttttttaagataaaaaatcggccgggcgtgatggcttacgcctgtaataccagcacttcgggaggccgaggcaggcagatcatgaggtcaggagtttgagaccagcctgactaacatggtgaaaccccatctctactaaaaatacagaaattagctgggtatggtggtatgcacctgtaatcccagttactcaggaggctgaagcaggagaatcgcttgaacctgggagacagaggttgtagtgagccaaggtcacaccactgcactccagcctgggcgacagagcgagactccatctcaaaaaaaaaaaaaaaaaaaaaagatataaaatcatatcatctgcaagcaaggataatttgactcatttcttttcaatttgaatgacttttatttctttctcttgtctaattgctctggctaggacttctagtattatgttcaataaaagtggtgaaagtgggaatccttgtcttatttcagctgttaaaggagaggctttcaggttttccccattcagtgtgatgctagctgtgggtttgttatatatagcgtttatcttattgagatatttttcattttgaggacaaatacatacttgttgagggtttttaccatgaagggatgttgaatgttatcagattttttttaagaatcttttgaaataattgtatggtttgcatccttcattctgttggtatgatgtatcacacttattgatttgcatatgttgaaccactgttgcatttctggaatgaatccctctcaatgatgatgaatgtactttttaatgtgttgtgaattctgtttgctagtattttgttgagtattttttttatcatgttcatcagaggtattggcctgtcattttcctcttctgctgtcttttcatctggttttggtattaggataatactagcctcatagaatgagttaggaagtactccctcctcctcacattttagaaataatttcagtaggattgacattatttatttttaaattgtttggtagaacccaacagtgaagccatcagcttttagccatttcttttatgggagacttctgttaatatctcaatacttgttatttgtctattcaggttttggatttcttcagcattcaatcttggtacttgcatatggttaggaactcctccatttcttctaggttttccactttgttggcagagagattaaatgtataaatgaacaatggccagaatttatatgacagtagagctttgaccataacctctgcagcaaccagtcctggaaattaaaccacagcttatgtagcaatagacccagaatggacatgatttggtcaatgacagccaacttacctatatttgccaaagctttcaattcagtaagaatcagagaaagccaaatatacccctcaaacccatctcataaaatgtcctgctcctatttagtctacctgaaacttctctacctcaacagtatcccatcagaaaatactagaaatctcctttttaaagctttccttttccctgcctgtttttgagactctgcccaaagcaagtgatggtagctgattcctctgtaaggtctgaatagtaaagtctggatgagcagtccctgtatgttctcattctgtttattcccacatttttgtattaatataatttaactataacacctaaaatctctgaagattcacacgatacagaaccggtctgccacttaggaactaaaatagccatttcactaaattttctgacaaatttactacagagtttagaaattgaaattgagatttcaggtaaaagcatttatgccttcccagttaattttaataaacaattactaagatcttatttaagctgaatgtttgctcattacttatcatgattagcaatcatcctgtacatttttatcatgtaaaagtaactgacagataaaatcagtctcctttatattaaagcatttctcatcagcattactaaatagtttctagtgattcaagactacataaagtaaaataaatggattatttacagggagaatatttatgggaaaggcaatgattattgcttataattactctaacacactatccaataggaaaaaaagtaagccatcattctggagcacagcaaaaaataatttttccttccagatataattatttcaaacatataatgaatgttttcttaaaagtataagctgaaaagccaggcatgtttttcaaaattgtaaataatcctcttatcccatattttatatttcaattatttgttagatatttgtgtatatttaccacacatatgagaaagagaattcagtagtcttatcaagtaatgtaaaaaatggacttctctgcctttacagtttaaatcataagacatagactgtttctaaatggggaaaacataaaacttaccaatatttctaattccctttgctgtgtgtgctacaatatttaaattgctattgtcattaacacattatattagaatataaatgtttcacctcagaaagcaaaacgagtcatgtgcaaagagatttcttatttaatgaacaaaaagatatgagccatagaacatacagatttcacatactccaactatgctttcagaaagatttaattctgaaaccctagcagaagtgaggccaggtgagtttcctccctccctcgcttcattttctattccatctctcagggttgtatcttagaaaagacagcgggggcagaaatgctttgtaaatgcaagcttgtttccagtgggaagtatgcacagggtacaaaataagttcaaccccacctcccaacctagttcttcatccaccatccctctgaagctgtgcatcccaaggattctttttgatgatgaatgcaacattatttctacatggctatttttgagtgttgctttggtttcccttctgtttgacagattttaaaacatctcccccattgtccagtcagatcttaggctctcctggacatgaggaaagctgagagctcagtgcttccaaacaaaccctatttgatccacatattcctccatgtttttggttaattcttgagtgcaacaggccatgcttaaaatggacagagtaagaaaacacctggctcacttgcagacaagttggcttagttagctggctcatcaaaattctgagaccatgtttagggatattatagaaacataataccagaaggattactggctgtgatattaagtaacaggatgaggtcaggccagcctttttagaaaatgcagcatacatgctttctcttgggtaactaatcaaaactttttagaaagttgtcttcttcccatgtttattatacatatggttagacttgtgttataattgacctttcaagttgtgatgtttcaggggcacctgaataaccttgtgattgaccacatttgtccccagaaggttggcccattaccagacaaatgatgtctattaacaaagaggttttcagctgtataaattatcataccataatttattttttcttactggtaaatattgatcttcatattttcagaggggggagtatcaggaaggaattagccccattttggtaaggaaaattggcatctcatttggctgacaaataacccgttttctgtagctatttctgtccaaagttctcttcagaacatcattctcataaatacagaattgtgtcattgaataaaattaaaatgaagacagctggataatgaaggtcctttccgttcttttattgtctgttcaacaaactaatagacttcattcaacacctgccagagtctcagatgcctgagtataagtagactcaggtataaaaaccttgaaaatctttactttccctatttatatctcagctcctagcaacattctgcattcctttcagagatgaatttctgcaccagctcgtctgctcctaactgttatctttcctttatatctttttctttccctgtctgctttgctgcccatctccttgttctcctcaattcttcttccatgctatcttatgttgctctggctctaaattctccactgtgttcactgtatgtccttaataccaaggacaaggacagtacctaatattcagcagattctcagtgaatgagccaatggaaattctagaaaaatctgtataaatttagtaaaattagtacatatttttcaagtaaaaacacatcacattgtatcttgaaatatacaatttcatgaggatagggatgtcactttggcatatctttgaataaatagttttaagcatgttggtgcttagagcagctttactttcttttaggtattttcaattttattactttaataatattcacactaaaggtggtacactcttaacagtcattatttttgcaaagataatatactggtttgtattatttattcaaggaagagttatgttttgccttttaccccataatttttctgcaacttttaaggaaatgcatcctaggtgatcatagaagatataattaaatatctggaagttatacctagagcctgtcttctgctcacatcagggaaggaatgaaatgggtctcaagtgttatgaaagtcacaaaatgtgggaactgtttaagttcacagtcaagattccgcgtggacagaatttacctaagagggagagcaaaaaacggggccataatttatgaaaaaaataatatctaatctaatatctaactctcataaagagaaaactttcacaaccttaataaaaactaatgggcttccaggttaagatggcaaactgacacatgtatctaattttgctccttttcaagtctcactaaaactatatatgagttatttttgtttatttctaaagacttaaacacactagcacggagagaatggaatggaagataaaataacagcaagaaatattaacaaactcaaaagcagatgacaagtactaaatgacatagccaatcggagaaagtcagagttcaaaccagcaacagggaaaattaagaatcaagtgattttatgcagaaagacttaggtatgattaaacttggggatgaagagagggactgaaaaaggcagtttgatcccatctcctatttcacaccactgaatatctacccccacctcagcccagcataattccagatattattctctgaagaggataaaatggtctttgcattgtgggtctttagacttattttaggggtggggtacattttatgaacaacagggtgattaaatgaatgtgtgaatactcaatgctaagtgtcaaggtcccagtcaccccatcctctaccactctgctcctagttccttaccttctaggaagaaatttgaaagatgtttttctgggaaagaaagtgattagtacaagaagaaatacttgctttcctctagaaagttttaaatcctttactctgattctagaaaataccagaagatgtataaaaggaatgctgggttgttagaagatgccaccttctcaatgttaacaatgtaacacagtttatgtgactgtaggaatggcccttcaccaaggagaaatcatgttttcaaatcataaagcctgacttctctgcccttgaataaggctatcacaaggggaacagagatgccttgctgcatttgtaactgtgcacaaatgactagagtagaacttgctccacatcttcagtttaggctggaaggtcaaggttcatgtgccaatactcagaaatggctacatcaagttttatgtaagtaattttttcacactgctgatacagtactttctatgagtttattgtgtttgaattagtctataccagactttctccaaagcgcatctaattatgagtctccaactgtggccggatccatatgggtggtctctgctacagtgccacgcataaatgcctgtccctcttctcacttatcatttccattatgcccctaccatgatcataatccttcagttgttacgtatctcctacttcataaaaagaaaaactgtcaattttctaaggccttttataacctatcactttcttcatgcccatcttaatttccttctttttcatattttttttcttagagcccctaaatggacgtgactcattcctacctgctggcctccattctcatgaactttctcacatacatcatcaccttccatgactcaaccccacacctcattcaaaatcgaatacaaatttcatttgttcatactttttcttctgtgcttattctccacaaactctctctcttccaaaatcctaacagattgaacatttaacagtttaacaacacataacataattattgttatctctgatgtgtcaatttgtttcttccttgaggaaagaactgattgggtcttatcctgtgtttagcacagggtaaagtcttgttgtacaatgggtaggtgcccaaattctgaagtcggaccaacctccattcaaaattaactttgcttgtgtgtccttgggcaatttatctgacctctatttctttattaataaaatggagggtataataatcaatcaaactgtctagaggataaacaagaaaacatgtttttctcaagatacagtacacagtaagcactcatcaaagtttagctatcattatgtcttttattaataaaataatatttgaataaaatgagaaaacagcattttgtggcacttcagaagatataaagcatgagctattttttcttttattatttttaaactatagagctatttaaaatctatatggaggacttcaagtgtactactactaccaccaaatgggggactactagctgataaatactgcactgccagctgtgaccctcactctcacaggtcccactacaaacaagcgaaaaacctgcaatgaaagaaatgtgacaaaggtggaaccaaggaatagcctatatataaaactgctaagtttaaccctcagaaaaacattacggtgtctgagaagaaactcttgaaacagaattgggaataaaatagaagtaaagaacagatttcattcattttaaaacaattggagatttatcacagtttatatgaactgaaatttaggtgactctggattcagttcaagcacaagagattatcagagtctaaaattcaattttactacccttcctttattgcagttcaaacacacaatattcctgttctgtggatgcctttgctagtgatggctatagactgagagaatgttgggctgcttagcttttgtaaaacatgaaatgtgtctattttcaaatgatttgtcactctatggagttatgaatccccttctaacaccccagctacagattaggataccctcaaagccactgatttgtcagaatccttttacaacttgattcagagtatgccaacagtaagatattaattcctttaggagggagacatgtacagagcaggaaaaaatactacaaggaggtctgtaacctcaccatctgtcaagtgacatgctgttatttttccactttggctctactccccaatatcagttcctttctttcccagtgtagacccagtcatttcaatatatccttcttagtagtttcagttctgctcctttccagccaatgactggatacatgtatatatatatatatatatagatatagatatagatagatagatagatagatagatagatctatatatagatttatatatccagttggatatgtatgtataaatctctctctctatatatatatataatatatatatatattcctagtcgattaccttttatatatcaagatctgcttctctatcaaagttgtcactccatgtttgtcttctgaaggcttctcatattccacagatggcattaccccacaaatagaagctgttaggtatttacttctgaaatttctttcactttttttacacattcctttactcttttagagagagatttcttcctctttcccatggttcctagatcaaaagattcctatacgccactatgttaaatgacagatttttaaataattttatttttaaaaaactagtaagcttactaaatctaaatattagaaatactgatattattggtatgatttataatgctattgcttttttatatttaccctaaattttcattttattctcattttctaacttatcttctctacattaattttgtctactgatatggaacatttattctatttaattctattttcattattgtaaagatgtcttggaaatttaaaatgcatataatgcatataattttctatgtagcaaagtatgttaatactttaaacttcttcctgaatataagaatagtaggccatttaactctgatcttcaacccttacacttctcctatgtagtgtggtcacttcaaatagtctttttttgttgtcattgattgtattagtctattttcacactactataaagaattgcccgagactgggtaatttataagaggaagaggtttaattgactcacagttccgcatggctggggagccctcaggaaacttacaatcatgtcagtaggcaaaggagaagcaaggcaccttctttacaaggcgcaggaaagaaaagtgccaagtgaaggcggaagagccccttatgaaaccatcagatctcctgataactcgctcactatcacgtgaacagcatgggggaaactgacgccatgattcaattgccttcacctggtctctcccttgacatgtgggaattatgaggatgataattcaagataagatccggatggggacacaaagcctaaccatattattgatggtgttttaccaagccttctttgaatgtgtcaacaccttttctaatttccttggtgatcattcttttttgcatcttaatttctctttcatggtggcatttctgattatgcaatttgaaattcatcagtttaataggtcacacacttgggatctctatttcttaaagatggcctttatttaaataagaccccccagggaaaagcattcaccgttgatgctccatcaagctggtgtgtgaaaatatctctggttccccttttaaaggtagggctataagcttttctaagagtcttagtcccaggtctccggactatgtgtctcctccaaatgccataagggcattaaaattaaaatcttagtatcaacatttaggatctatatatgggctaacaagcaagcaaagagagtgactttcaagactttcacaaagtaagcttatgcttacttccctgctttttgttcaaattttgtgtttttttgtttattcctggttccttctgaattaaagtagtattttaaaaatctaattaattcagctactacatattaaatatatactaagcatatatacacatgctgttataaattctgggtataaaaaaaggcaaatttcatacattcatacaacttatactctgttatggaaatagaggcaggaaatatgggaaaaaatgaattatttaaaccaaaaagtgataactgctaaaaggaaagtaatatagagtgataatgaaactgatgtacagactagttggggaaagtctttaccctgggtggccaaaaaaggctaatctgattctcagctcattcattcaagctgtgaccagaaggaacagccatgtaaacttatgttggtttaaatggtttttttttgttttgttttgttttgttttcccttctcactaaccatttatctcatttttggctatagctttttattccccttttacaatttcattctgtccctccccatttcctctttcccttcagcctaaaatatattcaaacatccagaagtctcaaaaatcttgtcatgatcattagtctcttttaagttactaccttgagtctctttgttttttgatctgctattctcttacctatctttttaaataaggtttttttccattcaccatttcgtaaagcaaaagtcaacaacaaattgattaaatctactaattgccaaactagtatctttttaatcattatcttcaagtaagaccattgattactcactgaaattctctgcccagcatcctcctttgtatgttacttttcttattaacacttgaatgctctttctttatcagattctattttctctgcccacttcttcaaagcttctgttcctcatggctttacccttcattgttgtcccttctagctctaaatcctgtctataaatacacccacttgaattatttatactattttatggtgagaaagcttaagagtcttctcagtgccacttaccaagttattattattattattttatttatttttatttttttgagacagagtttcgctcttgttgcccaggctgatatgcaatggtgcaatctcggctcaccacaatctccgcatcctgggttcaagtgattctcctgcctcagcttcctgagtagttgggattacaggtgcatgccaccacacacagctaattttgtatttttagtagagacagggtttctctatgttggtcaggctggtctcgaactcccaacctctggtgacctgtccaccttggcctcccaaagtgctgggattacaggcgtgagccaccgcacctagccaccaagatgatattataatataactattatagttcaggtttctttccatatgttgtttttcatataaatgtattgatactttaaatcagcaacaaattatagaaggttaaaagttgtaattaaattatccaaaatccaactactaaaacataatcattatttaaacccatgaaagtttagttttgttcctatacaggcatatacatgtctatgttatatatgtttgtattatataatgcttgtgattatatgtgtggagaaagagagagaaacagagacagagagaaagagagaagcagagacatatacaaacagatttctccgaatctttgcctgcagaaattgaaccatgggccaaaactgaattactttctatatgaagaggaataagaagacatttagaagctatggactagagttggaaaaatggcaagagttaagtgcaaaaaatagaaatagacatttaaagaggtatttttatgaaattccatgtataatacacaataaatttaattttctcactttccaatgaaatcttcactgcacataatctttggaaagtggatttctttcagaagaatacaaagtagaactgaattatattgtaaagagtaagtttggtataaaacaaaacaaagacaaaaatatgcatatgagaatatctatgcatccatatacataatagattataaaatttagactactttcatactatttaaaaaacttgactttattttctatagactcttttcatgtggcaggcaaccatttgtttaatcatcccaatttttctattattttaaataattctatagttatcctgttggggctcagaaaaaaaaaatatacgccaaaatgaaggacttagaagcagcttcagaagcaaaagtttttctctgatttttttctgttctcctgttgctcagttccattttcccctgaggctagtcataaatactagaatccttctccaaggcaggtcacagaagccagaaccccttttccccaaagctagtgataaaacataaaaatattattctaaaacgatctccatctctctgtgtaattgtactagtcatacaataattttcctacctaccttgtttgactataggtcataagacccatattccagcgagggtcttgccccatatccagaaggtagaaatacatgttcagagaagccaagaaaaatctagacagacaggccttgctgggtaccccactcagtctattaacataagatcataccttatttgtcccatcatatttctacatgattgtccatactttattgaacttaagcataaaaataaacaatttatcctgtgtctttgggtcttcattctgaaggctaccatatatacttggtaaataaatttatatgttttttcacctattaatctgccttttgtgagttgatttttcagtaaactttcagaggccaagggtttcctttattcaaaaaagtttggccaggtgcggtgactcatgcctgtaatcccagcactttgggaggctgaggcgggcggatcacgaggtcaggagtttgagaccagccacaccaatatggtgaaactccgtctctactaaaaatacaaaaattagctgggtgtggtgttgtgcgcctgtagtcccagctactcgggaggctgaggcagaagaatcgtttgaaccccaaaggcagaggttgcagtgagccgagatcgtgccactgcactccagcctggatgacagagcgagactccatctcaaaaaaaaataaaaagtttatcactttatattatttcctttggataggttccctgaagtatagtacagatatggatacagatgatgcacgtatgaaaagtttataaagattttcattttacgcatattcccaaattactataaggcttatgtcattagattttcaacacgatgctctgtaccaagcctattttaaaagttttggcaaatttgatagatttaaaatacatcttattctaactattttatttttaatatttttcaaatatttgtctgccataacttttataaggagaaagtggttaataatataaccatattctttgtccattcttccactacaatattaattttttatgtctgcaagtattctttatatataaatgggatcaaatttttgtttatccagttatccatttacatttcaatattgcttaggacattctattgatgtacattttttgaagttcaatttaacaatcctttctttgtaaattattttgtatgtaattttcataaactgtttctcaattttaatatcactgaaagattcatgtacattttctccattaattatgattttaaaattaacagttatttcattactccacctgaaagttattttggggtataaatgaatgtaccaacggtacacagcaccatatacatgaatactacatggtaatacaaatgaaagattttctaagtgtactaggtcagcttcagtgtatccttctgtactgtggcttttataactacaccacgactgaattattttagttgttatagtttgtgtacattagttactagtagggcagccactatatattttattgctttttgactaactctataaaatgacattttaagacaataacaaacatttttattacttctgcaatatgcccacaatgtacatttttttcatggctatcattaagtgattataatttcaaatatatctagttctcatctcagaagcaaaagataccactatcctgattatgctataaatcactataactaaaattacacagctatgaaactcaaccattcagatagctccaataccagcgaatcacttggtttaccaaattctttgtagaagtcacatgctagtatgatacacagagcagatgcctggggaaggggaaggtgagagagtataagtggtgtccaaaccaattccacagaagtttctgagaaacttgccatatttatttatcgatcgaaacctctagaattgtacacctacaactttctaatactatatttgcttttcccctaccacctgatttttggcacttgacactcagagaatcttgaggtttcactaatatgactaatattttcagccattatgaatattacacatcgttttccacataattacctagtgaagtctgtcatctccatcatgatcatacacatgttcttggccagaacaatgatgtcgttgcttgtatcatcccatatctcaatctcagcatccagcttactctttactttcttgaaatcagcaacttgctcagcaatcttttctttttctgcctcaggcagttgagtcatcttagcctaaaacatgtgataattagagttaaaatcattccactatgtcaaaagcattttaggaataagtagatattataggatactcataaaacttgttcatttaaaatcagaggcacaatatagttaaattcattcaattaaaactttccaggcttaatatttcatataaaaatctattaaattataatagtttgctctagaactataatgttacatttagaataacactgtagaacttggtgtccaacatacttaaatccattttataaaataaatgtgggactttgcaaatttctaatacgcttcaaattttaaattaacatcaatttagtgtaatgcatcacctttgttagaaaagtgcgtataaaaaggtggatgtataacataatttaacttgaaatgagactatgtctacctatgtgtatatatgcaattacaggatgaattagtcatgcctcaactttaacataataaagaaaaaacaatgatgcttttagtttgaattttctgtaaatatctcagcataatgcttgacacatattgaatgttccataaatggtagctatttcttattcaataaaattatcaaaatattttcatatgtctaataaattttttcattttgtttgtattttttctatgaagaatcaaattaagctacacaagactaagtttttaactgacacaagtgctatttcttagcctctgaaagtagtttgtagtttcttttctgaggaaatgtgtcctatgtgaggttgtaagagaggagcaacttttactactgctggcatatggcaaagcacgtaaatgaagacacagctcactacttctgaaatgaaaagtaatatgcaagcacgttaagtaaattataagccaccaacccattaaactgactcacgaatagaaatgggttttctccatcttgactaccggtcattatcattctctccattctcataaaaggtgtttaaatgttcaaattacaatagctccagataggttcaactggtgcttctctttacattctgtatctcagaggtcataaatctgtgattctatttattagaataaatagtgctgaatatacactggtatattatggaaaattatttactgttctcataataaagctattcaagagctgaactggttaagtgtattccaagttcagttacttggaatgccactgatttccaatatgaccttgaggaagttacctaaccctcctgtctaagtttccctagacacaaaatgacagtaattgcaactgctatccacctgccatgcagggaacagagtcaattattggataagattgcgactgaccctgttgtggacagggagctcattggttgcacttcatctccttaataacatctcaactcaaatggtgaattacaacagacatttacctctgacaagataagagccaaaagttgggcaatagtttgcaaaattaaaagttctagagaattctggtcctttttctcagggggaacaatagcagcaacaaaacattaagttactgacacctttgcagaaggttttaagtgcttctatgatttattatatgtcatcgatcaatttcaaccacgctgaaaattccaaaggaagacttaagagaatacttgatgtttggaaagtctaggtgaaaaattctttattgaattattttgttcaagttaaacaaagaaactgaggtacaaagcttaagaaaaattaagtaagtagaatatctctgatatatatcgccaggtggctatgtgtttaggtttctgcttacatctatagagcagaactctgatagaaataactgtcaaaggctttttcaatcactgccatctgaataagattatattgtgtaactattgatcttggaatgtgttaccaaacacaagaaacatttaaacttcatagcagccctatgaggaattattattatcccaattttgtaagtgaggaaatcgagtctctctgaaacattaagtgatttatcaagattatagtgtcagtcaatggtagaatcaggatgtaaatcagaaaatatagctctagagtttttgttctatcactaagccaacaaacacgaataatattgcccacaatataccaatatatacacattctccatgatggtatttctctatcgctgtctacctttgaaagcaattgttctccaaagaatagtcacattgtttagaacctaagtttccaaatctttaaattatataccatgatctttacctgacaggctgttttggacatcaaatgatatgcaagaacacactttttgagtaaagtgatgttaactgtcaaccattacttacacaaatagattcagttctttactctctgcagtgaatctcagaactctatttataatattatccattatttttcaatgaaaagctgtgttatcccaattgcctattaggcatttttaagcatagatttcatttactaatttaactctaaaagagaggtcggcagaatttttctataaaggacaagatagtgatatatgctttgcagctcacaccatatcactccgttactcaactggcagagttgttactctgttatattgcaagagcagtcatgaatactacataaacaaatcagtgtgtctctgttccaataacaccttattatagacattgaaatttgaattttacataattttcacatgccacaaatattattctgatcacatctgattacatctattctgaattttttcaaccacttaaaaatgtaaaggccattcttagctcatgtacaaaagcaggcagcaggccagatttgacctgttgactacaatttgccaacacctgctataaaactttcctatgaccagggaacacagatttttattgtttttctctgtcttcattatccttactttgtttgtaactcctgaaagtgctgaccaagtgatgcctgaaacattttcttgtttttgttttgttttgttttaaggcagagtcttgctctgtcacccaggctggagtgcagtggcatgatctcagctcactgccacctctacctcctagattcaagcaattctcccacctcagcctcccaagtagctgggactataggcgcccactactgtgcccagctaatttttgtatatttagtagagacggggtttcaccattttggacaggctggtcttgaactcctgacctcgtgatccactctcttggtttttgccttccccttacatccaactgccccttctcagagtcctccatctccccttatctgccaaacgcgcatctcccaaagaatctgtgctgacccttttaactttcttcattatcttctcccttagcacactcatctactttcttttcttttttacattgggaaataaaattgtaagtacttactatgcaccacattatgttctgaagtgtatataccttgtggaatacataatggaatactattcagccataaaaaagaatgaaatcctgtcatttgtgacaacagggaatctggaggaaattatgttaagtgaaataaccagacactgaatgatgagtaccacatgacctcactcatatgcagaatctaaaaacggtatcacaaaaggagagaatagagtaggggttaccaggagctggggtagtgggggagggggtttgagaagatgttggtcagaggataaaaaatttcatttagacaggaggaataagttcaagaaatctattatacaacatggtgactacagtgaatagtaaattgtattcttgaaacatgctgagtgagtgtaaagtgttctcaccacaaagatgataactgtgtgaggtaatgcatgtgttaattagccaatatagttcttctacagtgtacatataggtcagctacgctactttcatgacttcagccatcactgctatgaagattacttccaaacaacctcttcagtcctgttctcctttccaatactgtgatcagtacattcactgctgttaggaatacctcatcacagaaggatgaaaaacacactcagccaaaccatttatcctcttgattttcatgtttctcagtgatacttcctgccttccagtcttgaagttttatattttagaaaattatcctcttttctttagcctattctgtcagttgtccattttatcctttatcacatccatttccctctatatattaatattaccattcctgctgtcttctggtcttaatattctcctttgttttaaatcttcttgctttgctactgcttgattcaatctttctgaatatgatggaattgtgcaatccttcatctaatctccttatctttacatcaccttatcaaataaagggtatcaattcctcaaacaccaccattatatttgtttgattaaaatagaaaattcatataaaatgcctaaatcataaatgtacagttggaacgattttcacaaacagagcaaatccatgcacctacactcatatcaagaaaccttaaaaagattacagacactcggaagcctccttctatcttctgctagtcactatctcctaagggtaatcactaacttcatttctaaaactgtagatttgcccatgttttaatcttataaaggtgtggaataatagcacatgaattcttgtgtctggctttttgtattcagcacttaagtgcttgaaatgcatctattctgttgcatgtagttatattttgtttattctcattgctctatacagatattattccactctacaaatatatatatatatatttctataaatttattcatgtttttctataaacaatattttgaaaactattccgtttttggctatgataaataatgagtattcttggacttttctttaggtgcacatatgggtgtatttctcttgagtatgtatctaggaatggaattagtacatcacagggatcatcataacctttgtttctaccagcttttcaatctcatcccatcttacttccttcaacacactgtaccctcaagctaagctaagctatttgttgctgcaggtaaatatcttgagatattgcccattaattatttttgctcatcttcccttcccccaatttgttggtccaaatttaatcatatttccaggccagactcatatagtatatgcccctttctccattcttcaagtgtgtgtaattattctctcaaaatttttagaacatgttgtcagttcttccccctagatgttcatattgttctctcttgtagtctaatcttgtgaacacaactatcttatctcacttactagagatgttgttgaaaacaatatcatctttcagaataataattatgacattacacataatttttcatttgtactttttagatgtatttttttctccttcccctagaaaataagtcctcttaaagtaggaacatattgcatgataaatgtttgtttgtgattgttaacagaaatactcaagagctaaaaaaaactcaagacttttgagctcaaaattttatatcactgatcttgtattttcattgtcaaccacatttacacaaatgccaagcttttgcctctacacagatcttagattcatttctcttatgcacttttcctagtatttttcaaactcaggtccttattattcctccaagactgtattaatagcacaattgatcgtttttcatcttcatatctgcttattaattgtactatgctcattactactgcatcaaatattgatatgcttacattatttatctgcttaaaaaatttaaatgactataattaccccttaaaagagacaaaaggaaaagaaaggaaaaaagtgacataataggaaaaatgcagaaattgttgtcatacagaccaccattcaaattccactttggccaagtattagttatacagcaattaacaatcctaaaccccagtttcatatgttaaatgataataaatttataggagttgtgtgagaattagttatgactataaacaattgtacctggaatatattagggactcagtaaatggtgcatatataaataatgtatataaatgtatcatcttggcctccaagactttccacaaaatggaaaagaaggataactaaaatattcatgtagcctacctcacagagcctaggcaagaaccaaatgaaatattttgagtaagtgctttccataagcaataaatgccatagaaatatagcgccattataattatcttattctcagaagccccagaatccacatcacttattttgcagataagaaaattgtcccagaaaggggaaatgacttaaaagaactctccagctggctagtgacagatgtgatgtttcagtccatgtgtcttcattagtagctttccctttccacaattttttttttggctttccttaactataactttttttcatggaaattaaattcttaggtaaatcatataactttgctaatttctctatccatgaaactggatgaaacatagaaatattattttgttaataaataatccacaattatgatttttttaattttataaatattagagaatttctaattaattcatatcactcatatgaatgggtagctagaactcaacattcaaaataaaatgtttgataaactttaaaaatatacacatggtatatatacatattggaaaaatagttctctaatgataactcatgttcttaccttcagcgtgtctcaaatttaatagtgacatgtacgtgttttcttaaaataagcctagaggcatttgggaaatagatgtatttttaatacatcaaaagtataaatagcatagaacactttgatggaattttagaaaatataaagtgcttttggcaaaaattcaacctaattaaaattttgagaacaaatttatttaagcaagatttatgcattggtatcctaagcatactaaattgtgatctcaaatatattcctgagaattcattaagagcaattttctgtaatattttaaaattaacatttaggaattggagttggactttaagaagtggtatacatttctacatttttatgtatagacctctaaatcagacttaaaatatatatttgctttaattagctctcagtttcctcatccatcaaaaaacacccctcttaacacccagtgggttactttcactgttataaaactgtctcattttattataaaactttataggcttcagggactgggtcgaaacagagtaaattatcaggtatatttgactgattatctatgtcttaaatataataatgatagtgattgacatttgttcacacttccagtatgccagtcactctattgagcacttttgaaaaaattatgccatttaaataataatatgatgaggtagatattaatgtccatttgtcacaatcatggaaatgagttccttagggaacatttgcagatctcctataatgaaaccctctccaatgttttatttctttttcataagaaatagttatattttatctgtgaatctagtttctctccttgttctagagataaataaaggttgtaaagggcatttgggagatggacgaaggaatctgtgtataaactgagtattaaggaaaattaagaagtgattgttaattttgttcagtgttgtgatcatattgtggttatataagagaatgttcattattttgggatattcctgctgaaatatttagatataaaatgctatgatgtttcaaattactttgatgtagtttaagaaaaacccaaatatggctctggaactatggttaaactgttatttctaggtaatgggaatatgagtctgtattgtactagtgattaaacatttctgtgcatttaatttttcacaataaaaaatgaaacacaaataacattttctacaattttttgtggaggcatgagagatcttacaggatatataatatcttatttcaaaatatcattccatctataacatttgtgaccaataatgctttcaccacttttcggactttcctgaaagtccaatgctggattctctgggcctgagaaataaagcagtccatgcacattttaccaataaaaattaaaacataataaatgagactcatgacctccagaagtaatcttcacatagataaatttcattcaggatcttggcatgtatcataatgacagaaatttacacttaagtgtggctgtagcataaacctttctccaaaaagaaaagttgtttcaaaggtggtgatctgtatggagcccctaaaacaagatgctgatgtgagcaggtatcaagaaagctgacgtgaatatcctcatccttttgacagatgtgatcctagcacggccatatagttattgcaatatatattttatccagaaggtgaagatccaagcctttatactctttcctctaaaattatatgtatatataattatatattgaagggttggtaaatttgtttagcaagagtcaatctttaaaagcctggttgatttgtttaggggcatcaacactaaagagtttctattcccaacagtgaggaccaaccccaggacttcagtgacctcatcactgaggagattctacttgagctgttaaccctttttccacttgatatcttacttttgtcttccaacaacaggcaagtacttccttctgaggcactgaattacatttttagacagaggtagttattagaaaatctttatctttcctctctatgtctacatattagcctgaattcagacctctagaacctaaaggagtatatgtaatctattttccacaagatgatcttgcagttatgtgaaaaataatcatcagatgctattaactgtcatcttcccattctctcattcattccttcacctattccttttctgtagaactcttcaattccagacacttcaagaacttgttatccagaagatcagaatcaaggttttcctttggggatatttcagtatatcatcgtctctttcataaaatgacttccagacagaattgcaaattctagatgaattctgaccagtcaagaaaacaataatggtctttgttcaggacactatattcgcactctacaaagaccaaagttgtaatagaaattttgtaacattcatgtaaattatttactcatacttaacactcaactgaaatgcccattacaaaaataaactataactaagccatatcaaaactgtcctgtatttttatttttaaatataaatattgcaaagatttacactaaatttaatttatttaattgcattgtgttttctttggttcctcgttccagaatgctgatatactttttgtcttttgatgctgccaaaactgacaatatagaaatcctcaaacagttcaataaataaatattataaaggctgtgaggaaatcaaacaatgctctctaaaagtctattttattcacaagaatgcctttaagatgctattcagtgcccagaaacttatactttgcttataatttgaataagtttggttacctgaattccatgacccagtttacagtaaattggaagtagacagaaggtgtattagtctgaccacaaagatggaaaagaaaatctatcaaaaaagagacagactactcagtcagataatgaggcccttcaagttataaataagctttcctgcttatatcaggacaccttcatcctattattgtattatagcatagtacaattatatttggtcacaatactgacaatgagtcatccacagcatcatcacccagcatttattgatgtctactgtaaagtagagttggatggcaccatttctgctctcaaacagtttaaaagatccctgtgcagaaaaagacgtatttagaacattttggttggtaaggtaaagatgcatataatacaattagaaaaccaattctagtgacttttaaaaaagttaaatcttattatatgaattttataatgacaaattatatgaatagtataacaactaaagtaagatttgagaaagaattatatacctcctagttttatatgtattttcttttaatcatatttttgcatgaatataattttattactatgtatgtattaaatgtgtaattgaatataattaccagatttccctccaaattgtttatggaaatttgaaaatttcattctatctttctaacaacaattttcttgataaaataacaatttgaggaatattgtatagaattctaaatatggcatttgcttgtccataaattatgcttacatatgtctatattattatgattcaatatgaccaagactaatgatccatataaatatgctaattatagctccttccattgaaaaccagatgcaacacctgtagtgacacagtcgtggcaaagaaaatataaaatctattctcattatattattaacaactgaatatagattatgtaatgcacaaagaaaaataagctgttatatttcacataatattaatctattgcctatttactaggtttttaaaaaggtaaaataaaatagtttatatcaatttgagtaatatactactattatttctttctgactccattactgggtaatcattcatgattcggatcgcttgaagtcagtttagtttatgacctaaacccaaagttagcagaagtttccatattctgaaatataaataaaacagtcatgcttcttctcatacattctttgagagtctcaagtttactcaagaacttcataaattactgagggcttatattcccataggccacttttcttctctgcatttctgatctcgatctactgcattcatttgagagtgatcttgtataactattcccttcttactccattatagtaacccaacattgtaaaattcttcaaaatcactcttatatatatacaagagagtgatcttgtataactattcccttcttactccattatagtaacccaacattgtaaaattcttcaaaatcacttatatatgtcatttgtgtacatgtgaaggtttgtgaaaatgtttagggacaacatgagaattttacaaagtaaaatgacttaacattgcaatatctctgatttttacttaaagatgtagaatatgggtaaaaaagtatcgcttccacatttacatcaacaaccaaagccaaaactctgcaagtccatgacttttcctaaagccaatcatagttgtcaaataataatttcactgactgagttaaacagccaaggaaaattttattcaatactgctgcaatggaggcagagatggaactcaactctgctgaagcgaagtgaaggagagtttttaagcactggggtgagctagtagaaaagtactggaggacattagtggagatggtcaatgtcattagaccatctgtgtttgctaaatggtacttactgaataggcttctaccctcctacagagagtaggaaatagaggctttacctttcttgataactacatttcagagatggttcacagatgcttaagaaagatattatattttgttaaattggcaagaaactgggacaagatgtacatcacaaagggacagagaaagaatttacaatgggaagttctctaaagtagatgctttaagaaaagggaggccaggggcctgtactcagaaggaatcccatcaagacaaggagaaatttaaggctttcttggtcagaagtcagaagtcaaccaatgaacctgagatctagggcaataagcgccttctgaaagagatatgatgtaagtgtttgcttgccttgggtagatgccacctgacactggcaagtagaattcagctagaagagttgacaaattagttgagtatgaatcatcctatggtggcaaaaagtaagtaattgctcaaaaaagaaggacctgttaaaaagaaacaggatgtccaggcctggtggctcatggctgtaattccaatactttcaggggctaaggcagggggactgcttgaagccaggagttcaagaccagactggccaacatagcaagaccccatctgtaataataatcatgaaataggaaaaaagtaaaatttaaaaaaagaaaaaaactttcaataccaaaaaaacacaaaaaaaactttctatatcaaaggttggacaatttggtcagtgaaataaggttaaactccatagactacaataaatatccatgagttcatagtgatataaataaataattgaatgaataactaaatgtgggagaagggacagctcttccttaaaactccaactaataaatatagaagaagtgagcaaagtagaaaatcatgggttaggcaaacaccacagtaattattctttggcaaggttcattgatggagattaaaatttataggtgaacatttgagaaggaacaaaattgaatagtcttaaagcactgcactttggctgggtgcagtggctcacgcctgtaatcccagcactttgggaggctgcggtgggcggatcacttgaggtcaggaattcgagatcagcctgaccagcatggtgaaaccccatctctactaaaaatacaaaaaattagctgggcatggtggtgggtgcctgtaatcccagctactctggaggctgaggcaggagaatcgcttgaacccgggaggctgaggtggcagtgagccaagatctcgctattgcactccagcctgggcaacagagcaaaactctggcaaaaaaataaaaataaaaataaacataaaaactggcactgcacccaagatattaactacaaagaaaaaaaaaaaacttagtttttcagtggaaaaagccagcaaccaacaccaaatgacaaaaaccaacatcaccagaaataagatctattaatatcttgaacctcctgatttgatggactgagaaggacatgttagttttgtgatatttcctccaaaaatgcataaccttaaaataatgaggaaaacataagacaaattcaaattatatgagattctataaaatacttcatctgtattcttcaaaaatatcaagatcatgaaacataagggaagattcaggaaataccatactctagaggggactaggagatgtaacaactaaataaaatgttgaatcctagaacagaaaaagaatataggtggaaaaattgatgaaatttgaataaaatctgtggtttaattagtagtataataccaatggtcatttcttcattttgacaaatgaaccctgggtatgcaagttgttaacattaggggaaattaggtgaaaggcctataggatctctgtacttttttcagctttctgtaattataaaattacttcaaaataaaaaattaaaaacaatgtaaaatatgcacctgaattgtcatatgtatgtcagcaaatacagaataatttacttcatggtggctaccattttcagtcattggcatcctgtcttcttagatgggccccatctgtccttttctcatctttcctgtgtgttctcctgcagcaaaatactgcatattttctaagcacactttttaagtattgtcatatatatattcatccatcagagtctcatctcccaacacggtgcagcatattttcctgaagaaaaagagtcccttccctaaaggaaagtctaaaactatttttttttctctttgctagagatcttcttagtgaggagtaaaaagaagtgagggcttaagtaaacaagaaaacattatcctatgatcacagatactcaccaaagccaatttgaatgttattaatagcttataaactgagatgctataaaaactcacctaattttggataaccacatagcttgtcaattaaagctctacccaatcttaatactagaataacatcattaaataacatgcaacttgtaatttaggatgtttaaatggatcctgatgtctcaataaaatattcttgctaagacaaactccacaggggtaacgcaactggaccaagcagcctatgctagtcttctccagattcacctcccacttgagtatttcttcctaattatcattgccacaacctccttggtttcacgtgagggtcaaaggaccgccacacactttctacctaacatcttgcctatgaaaaaataaaatttctcttaactatctttgatcagctagcataagcctggactatatataaaaatattagacaagatattaaagattttgaaaggcagacagatgcagagtgatatggtcttggtaaagaggcaactaaggtctggcttattcttctacgctagttatgacccatcctatgtattgtggaaaccatcgtatatccattactgatcacccaggtacacaaacaggatattgtgtcccaaatataagtataggtagccaagtcctacagaggccagggttttcttattatggctttctgagcactcacttctccaagtgatttacattagaaatgatagtgagttggctgggtgtggtggctcatgcctgtaatcccagcactttgggaggccgaggcaggtggattacctaaggttgggaattcgagaccagcctgaccaacatggagaaaccccatctctactaaaaatacaaaattagccaggtgtggtggtgcatgcctgtaatcctagctattcgggaggctgagacaggagaatcacttgaacccagtaggcagaggttgcggtgagccaagattgggccattgcactccagcatgggtaacaacagcgaaacttcatctcaaaaaaaaaaaagaaaaaaaaagaaaaagaaaaaaagaaaaggaaagaaaaaaagaaatgatagtgagtttgcagaagagaccaaactttcaaaatgtagttctgcaggctctgaaagtatggcccatcagaatgctacagaaaagtacttaaagcaccacaaaatatttgactattctgttgcatgccattatcaaaataattcatgtactccataaatacatacacctatcatgtatccacaaaaattaaaaactaaaaaaaaagagaatgggtcttccattacagtggtattagttttggaacttcaagcaatttgtaataccttgaaatctaccagaaattgaagatgatttctaaaattctagattacttacaaaaatgtaggcagtacctaaaatagatgtttactaaataatgttttttctaaagagaatttttggaattagaaaaaaaattcttagaaaaaggactcatcttgattagttgaaaatgttttatctgtatacacactgaatttttctattttctctaagcctccttcagctaaagattcatttaataaatccccaagtgagttatgaattatttccccagaggtgggacacaataatcaaaaaataaaattgttcgggtcaatttgtaaaatagaagtttcaatggcacgtttcaatgttatatatctatcatctatctatgtatttatatatttatttgtgtatttttttatttaaggtgatatgtaacaaacttgagatcttataggataggagaacactaggacactaattaggaactggtcccaggaacaaagaccttctggactcatctgacaagataagaatcatcaagcattcttccagcagaaagtgacaaagccctccttgagctgctcatgagaattcacaaagtaaggcaatatgtgaagaattaagatagaagagcttgcaaagaatcccttgtctctattagattccaagattgagccttagaatatttcaaaatgataaaaaaagagagtttaaaagatttgtagaagaagaatgaaataatatattcattttgaaacaatatattttcattcaggattattaataaaatgctcatgttagtgatacatgattcactaaggaaaataaacaaggaagagaagatggataaagtgataggaggaggaaacatgacacaattgagaaggcactgaggtagaaagagaattggtgtttgttggtataatttaaccagttttcattcaatcacctggaccacagaaattctcaaagtacaattcacatgcaactgtaatagattacatcttgtctgtataataagttaatgtgcaagattttgaatattttcttatatatagaatagtattattttttctagtttcttttttgatttatttttctttcataatcaagaaaaaaataaatgaaagagaatatgggagaatgtcaccagagagtcacaatgttggcatgttattctgacaattcaaaaaattctcaaagaatctaagttttaagtgctaaaaactgccagatcattttttatatttattcttctgattacagtgcctacagcattcgtaattctccaaacaaaatcatgaggcttaattgttttgaaatatacttctgtgttacattgtcagatctcaattaaaggaatcttccttctatatgcaatggaagtaattcaatccctttttatgtagtaccataatttatgttaaaatatggcacaatcactgcctaagattcaaaacatgtaaaacacccctttgctgctgcaagaatcaaaacacagggttgatggtaacacctatcctacatcagtagcactaacaatacaatcagtttgtacaagctaaatccatctggtcagaacacacaccaacattaaataaacaaaacataattcttcttgtcttctgaatgtgaatttggagggggaacatctggattagaaaggcccatagcaatagacaaggcttttccaagtaaaattccattcaggcactagaaataagaccctctgctcaagaggcagcagctgacacacgagcctatcttagtactgagacaggatatagatgaagccatgtctataaatgagcacaaaaggaaattaaaagtaaggcttcaattagttaagctttcaaaggtaaaactctagggtgtttggaggaatctttcaggaagatatattccagttttactgcagactcaacacaaatggctctcagacaagtcacatctatagtaattggaaacattttcaaagtaaaagatgagagaccatggtttttgccaaaggttcttaagcatgggctttcatgggcatgcgaattttttttaaaaagtagcagaataaacatatgtttgcaaattattttattttaccaagtaagggcaataaaacacacacgtttaaaacaaaaaatttaaaaaggaagaaaaaattaccacaaaaaacttaccatccactatcactattcttttcttaaaaagaatattttaacctcaaaattaggaaggactcagtagaaaagaacgatctttcctaagaaagaatggctgttcctttggttgattttacctctccccgactccgcaatcacaacctcattgttacttggcaatctcttggaagattattgttagtcacaagtgatgtgagaggtgtgcgctactggtgatagagtagtaagaaattatttaggcagttagtgagggtgaaagagttcttggtagaattttcttttaataaaaagcagcccccaaatcatttcttttctaataaaaagcagcctgaaaaatcaagttacaagcatagataagcaagatggaaatttgcatagataaatggcatcagctgtacctggaagctaggtacatccaacatggtgattccttcttccttttccttgtcgccacatgtgcaggtgtcatggcaccagccaggtaaaaccttatctacataataaaagatttgtgggctatgtaaatagcacacctggtcaaaccaatcccctgggcccaatttaaatcaaacaccatctcctcaagcccctctataaagtggacctcatctcaccccaaacccagaaacatacttggggaccccctttctctgcatgaggaagctctctcttctttcttttgcctattaaactttccgctcttaaacccactccgtgtgtatgtgtcagcatctttgttcctcttatcgcgagacaacaaactttggctgtttccccagacaatgatggtgcttcattggcatctactgggtagagaccagagatgctgctaaacaccctacaatgcacagggcagctactacaacaaagaattgtctggtccaaaatgtcaacagtacacggtagagaaactcctccctacactgacattttagctaaggaccagtggacattttggctcagactgaccctcatgtaagctaaccagtttacggagccagtgatctctggagtgcttggttgactcttttgttttcagtcatttttaacaataatcatcagcaacagaactgcagtggtggaattctactcaatcaattagaactagcctgaaaaattgtcactaaaatctattctgcaattctatcactttgacatcaatcccactggcatattagtttgtatctgaacttcagggcattagacttagtctagaggtagtgctactgtttggaaatgaaagaatatttagccagtttgagacaagaattagtagcctctatcaaaagatagagaacaaaaatttcgtcttacagtgggctttaataatgtatgcttcattaaatattcagtaagagtatatatactttctattaatgtaactttttaaagattaagaaaatcaaatggattaacaaccacggctcattctagatagtaaacttatagatagctattttttccttatgtttatttgaaacattttggtctataaaattatgcacaaactctcagtagtatggtaggcttctttttccctctgtactttcatacagaatacctttattttcataaaatattgtttcatataccaaagattttgaaagcaatattttaagactattcttgtaggctacatatatatgtgtcattattttacaaattatattgcaaaatgagatcatattatgtatactgttttgttccttattttttaacattataaagtagaccagtgtctgtataatatagatttgtcacattttataactcttatttcatgatttagatctggtatcatttatctacatgttattaatggttatcagttgtttcatatttatgtagataggtaggtgttttgtgtgtgtgtgtgtgtgtgtgtgtgtgtgtgtgtgtgtgtgtgtgtatactgagtggtgaatatctttctgcagttctccaaatgtatctgggcaaacattctagaagacaaagagaatgcacttttataaaggttttcaatgcttacttcccagttttcctgcagacagcttaccctaattggtatctccacaaagtgtttgagtatcaattttccataaaaactttctgacaatggatattaacaatcttttcatgtcttcttcaaatgttatccgaatatagtatttcattgttgttttcatttgcatttttgtaatctctgatgagatgggacaacaattaacatacttactataaatgtacatgtattctttatgaataccttgtaatagggcctatgcccagttttctgttggccaggcgtggaaagtggggtgaggagtcatttcttcttattaatttgtgaaaatctatttctatgaatatataaacattttcttatataatttgtgattattatctcctcaaatggatgtttgtctttattttgtgttttgtttgcttgggtttaccttttttattttgtattctcagcagtaaagttcgcgccccttttcttttgtttttggtctttggtatcacatttggaacatcctttaccatcctaaagtcacaaaaataaatatttactcctttttatctagtacatatagggccctttgttgttgttgtttatgttgctggaactcaggagctgaggattgcattagtcatattcttcagttcattgcacactattactcttggtaaatagagagtcttcctgccccaacccaaacctctcctctctttctttctccctcccttcctttgctcccttccttccttccatccttccttctttccttccttactcccttccttccttcctttcttccttccttctatatacttttgtttattcctattccttgtgcctttttttctattccctccctgcaaattaaaacataaactgtttttttaaatctactctggttcgcctttaccttaggtaacttatatttaattcactgcacaatatgaatcccttatgatttgaagttactgttctttataaacactatattttaatagaacagaccatgtgttaggcatctactttgtttttatcactacacaaggtcctttatatgcattatttctaattataatattacaaggtaggtattctctgagttgaaatataaggaaccagtatctcagagaaatatatatatatatattactaaatgtcatactgtcactaataaaaagagccaagattaatcttagggatggtgaccctaagacccaggcactcttggtgcttcttacaaaaacaatagcaaacaaaaccaagcgagttctgcatatttttagaaactatatttgaaaatgaaatcctttttccttataacaccattttatattattttaggaaattttagtaacagtagtttctaatttcatcatttcaaagaacaacatgaatctaatgctacattcgtgactacataattgcaagcaaacggatttaggcatctggtgtgataacagccctgacaacacagcacttcttttcttctgagctgcagtttgaaactggaccagggtaggcatgtggctcaagagctacccatctataaattaactagaaattcatgaaagaatcccatgtaaaggactttgtacataggaggaaatttatttagcttggccaatcaggctggctctccccagaaacccttctgaaaaatctgaagagaactaattagcaaggtgaatgttgccaagctgcaaaaatagcagagatgtcataaatgtgaatccactcaacaaataatgatgacaaccgtgatagtggtggtggtggtaatgattatgatgatgacagatattttttatcacttaatgatacatcattccttataaatattaactcctagaagcctcacaataaccctatgatgtatgtccattttaaaaataagtaagcaaaacacagaaatgttcagtaacttgctcaatgacagcagttagtaagtggcaaagtctgattcaaacataggagtctagctccagaaattgtgctctcctttaaaatggtcttagcatcagaaacgaagagacatgtttggaggctgactttttctaaaagctctgtttcttacaagtacatgactattacatagctgatgactttacactcaaggaaatgcttctattatatgtctgttcatatttacatgggattttagccaagctttagatgtttagagtgctatatagcctaaacaacttatatattagaaatacatgttcacatttctaaaaaataaatgtaagttagaagttactcactgattaaaaatatgaatataaaaatactatttcggttatggtactttcaccgtacaaaggtaatttttagaatattagaaagcacgtaaaagaaggtgttgcatttggcttctttttctgctaccttacctattactacacacttattgtctttagtaggaaaagatgtaagtatatttttgttaaccagggactaataattcaacaatatgtatacatgttcaattttcaacataaatgaaataggactttttcaatgatgacaatttaaggcagaaaaagcagagacatacttgctagccagatgtctaccacaaacacctttaaacctacaaagagaaagaatcacctgagtactttagcctcaacatttttccaaatgcccattgtctaagtaattatctactaaaatactattttggaaatataggagctaccctatttattctgtagctacattataattggttggattcaagtgctgtatctgaaacaaccccaccacccccaaattttctgcacaggtctcttttcccaaagcacatatatggttaacactgtttatttattgactcaataaatatttaaagcacatttactagccagacactgttctaagtgtgggggaatacatcatgggaaaaaaaagaacattaaaactgttgccttcattgaatttgctatctaatagggagactaaacaaacaagcaaatatgtaatacatcagagagtgaaggtaatgttatggaaaaaagtaaagaaaaaatggaaagaggttataagagagttggaaatggagtcacagttttaagtcagtggttagtggtggcattactaaaaaggtgctattcaagagaacaagtatgtcagaaaagaggagatttgttgggggatgaagtctgaaatttgaaggaaaacagacctaaagccaattccttgaggaaaaaaaaatggtcaccaagtaatacataaaacttcactgtaagtttagaaggttgcaaaataataatataaagctatgcatataagataatttccagtctagctgacatctttgcttggtttttcaactgacttttagtctagtcacagtcaaaattaatttctgctctttcaccatctccagactgctcaattcagtctcctctgtatcaatataaatagtaagcccatcttcccagttctgaagccaaaaccttgagttgtccctgactcctgtctctctcattcccaatatccaatcttttagcaaatttagttagttttacctctcaccatatatacacaatcaacaacgttcaacctccccatttctaaaatcctggtctctgtctccaccatttttcaccaaaataatagcaatggtttttaactttctgcttcttcctgaatcacttctcagactattttcaacacagcattcagaaagactcctttaaaacatgtcatatcatgattcttctggcttcaaacccctccaatggcttctcattctactcaaagtaaaaggcaaatgtcttatgatggtttatacatcatctggaccaggcctcccttttagtttcagacttctattactgctcacttcaccaacattcacctccaaaaacattttcttctcagaacttctctgcttgctatttcttccactgtaaatgcatcgatgagtagaaaactctgtttaaagaatggatggcaggctaggttcactaagtagcaagtaagtcacatatatcacaatataccacttaaattcatgccttggtggcattataaactactaaagatatagaactttggtttttttgtccatgttataaggtggaaaacgggcatttttgaataccaacgttctactctataaatcaatggaagaggagagagatttaggcttaaatcacagaagttctaattgttgcaaaaatatacttgatgcctataccttccctcactctaaaatatacttcatcattggtgataagaaaattttgacaacggaaaaactaaattaagaaaaactataataaaaaagatatctttttaatttttaaaaattatatactaagcaattcagattagctattgaatattaatttttacatagaacttcccagtaaccaaagcaggatgaaaatgtacatattttaatgaagctccactgtctgataagtaagagcatattaagatatttggtaaaaatctttcccagattgaaatttcaagaagcatttattaactcgtatataagaagttttggatactataatatacagtgttttaaactttaatttttctctgtctagatttttatacagtgacttataaaattaaagaaatgacactaaatttaaattcaagtaaagaacttaaagatcaaactgctcaagtacactactttacaatggatagagatagagcctagtgcacttgacatgtaaaaatccaaaaggagtgagtaaactgtcctttagacagcttttcagcagaagtttttgttttattaaatcaataggggctaaagtataaagaaagctttatgagaataaagggagttgggctcatctagaagaacttttgaaaggaagtaaaaaagacaaaactagaccattctgacatggaaaaatcagaaatataggctcagggaaaatcctaactctctgtcagaaacacaaggatcattgtagcaaataaaaaggattgaggttctatatcccttatatggccaggaataaaatggcgtagtgaaggacttcggcaaacaagcagatcaattaatatttacactagctggtactaaattgaatatttcagtgtagtgtctaagaatttatagtaagatttatctggcacaaggagttacaactgttggaagaaaaaagataaagaaataaattcatgtaataccctaggctcaatatattagcctagggtgtgcttttggggcaagatatcttacaaaataaagcctctccttatgttctttcctatatgacgtgattcacatatgaatctcctctgtactaagtagtgtcctacgttctgcaaatgtagtgctaaaagaagacaacatgtcccctgctgtaatggagtttagaatttagcagggagaaaaatccattatataggaaattatacagacacaatgaatatcaaaatgtgagaatccacatgtaatggaagattattggagggaaactatctcagacttgcgtatcagagaaggctgggctaatctggaatcctaatgatgagcagatactagtaaagggaaagagggggcagcgtaggaattgtgtttctcagagataatgaaatggtgtgagggtgagcctgatggttgtaagacctgagatttctgcacgaggaggtagcattgaagagaaaccggcaaaatataatgcaaatgagagcagaccctgaagttcctttacagagggcattaggagattggatttcatgctaagggcaaggggtgacactaagacctaaaagggcttttatgtatgatgatagatgacagatttttcactttggaaatatcacaggagcttaagtatggacaatggaagtttacaaaactgatggcaggagacaagttaggaacatgctgcagaaatctaggtgagaggtgccggtgcctaaactaaaggagggaccaagatggcatgaatgttcccctccgcttgaaaacggctttctccaagttgtaaaaccatctcctgttataaagaaaacatttatgagaagttttacgatttctttggttaaaggcaattagcaaatttgatggactataatccctctcaccatatctctgacaaatctttgtttcagcagagttgagctcagaatgaattctagcctttgttccattgcaaaagccttgaataaagtcttcctctcttatttaactttggtgcaattcttctttgacagtggtgatagtggagatggtgaaaaatggacaagttcagaaaatacttagaagagagtaaaaccagaacatgttgtatgattagctatgggaagactcaaaaactattcctgagtttagatttgtgcaactgaatgtacagaggtgccttaaggaatgtaagagtttgagtagattagtggattaaggtggtgcatttaggtttggaaacagtgggatctacagatgcctgtgattatttcaaggagaggaaatttgtaggcctcccaatatatgtagtcagagctgaaaagacaggactaggctagaatcacatgcctacatatgatatttgaaatcttgggattatgtgacaatgtctaagaaaagtaggaagagctggaggactatagggcttatatgagaactctaataaaccctaatgtttaaaaatagatagaggaaaaggaaaccatgaaaaatatgaaaaagatcacccagaaagataggagagcagagttactgccaaacataaaattgaaatgatagtaaccaatgatgagaaaatgtattgcctgctgtgttgctgctgattaatgaaattttatctatattgattaaaactgttttttataataagccaaattagatcatgaagatggtaatgaggtcatgtgtcccaatattctgtaaggtaattccgtacaaatttgagttattgagagtatatactgataataattatggcctgttaaaatgtttttaatttttagagtaaaccactcatccatggaattgtttttctatttcatagtgaaggatattcaggtaactgcatgtaaacaagcaaaagtgaggcagtttttcctatcaccaacataaagtttacatggcattttttttacactaagaaccatcgcaagtattttaagatttgatatgctccagttcatctgttgctattgacgttttgaggttgtgtccagtaacctaggcaactgttcttatttctgtcctaaattacttctatttatagaccttatatagattcaatggccccagagattttctctaaggcagggcaggttgacaaactatatgctcttaagtgaatataatgttaaacacatgacagaccttagtcatcaagcaaagactgcatattacaatttctgtaatttggggtcatcagtatatatgacaaataatgtatctttaaaaatgtagtataacctggtcacaatgaaatatgaaatgactatcgttgaaattataatatttaaatgtcttgtttttaatgttctattcattaaactcaattccagcaattagaactagcagattcaaatatccttaaataaaaatcttacccagtctaattcagtgctaacaaattccttttctcaccactcacctacaagacactataatcaaagtttaagttgtgtgagacagaacaaaacctttgatttagtatttagaccttattggatttcaagttgtacaggcggaggaaagaatgactgtagaatatgttcttcttgggcaggggcaaagaaagaagaggtaattataaatgactacttgcagaactatctccaacatgcatccaataaatatcagaatgagatgtatttttttctctttttttaaaaaatcattatacatctagaaaaattaaatgttgtttttttcttttttctttcttttcttttctttctttttttttttttttaggcagtctctcactctgtcacccaggctggagtgcagtggacacaatctccgctcactgctacctccacctcctgggttcaagcaatcctcccaccttacccttcctagtagctgggattacaggcatgcattgccatgcccagctaatttctgtatttttagtagagatggtgtttcaccatgttggccaggctggtcttgaactcctggcctcaagtgatccacccacctcagcctcccaaagtgctgggattagaggtgtgagtcactgcgcctggcagaaaaattaaaaattgaaaagtttaagtcctatgcaactttatgagaactgacagagacagaaactaatggattaccaagctaccaaagttccacaaggaagaaaaactcccagtgcagagccaggcattttactaaatggtgagggaaataagaacttgacaactattgggtcaacttttcggtgatgttgcattaacaagagttgcttttttggatatctatttcagttctagcttacttttgtgaatacagatttacataaacttgctggcatcattaagaatcacaatgccttcttccttttaatctcttaaagcatttcttcattagtccccttcttgaggcaaaaaataatttcaaaagacttctggtagtaaagtgtccatgatgtcaaaaatacttagtaccatgaaacaggaaaccaagtagtcccatatcaggagtcagagagatttgtatttacaaagctccctgagctactcaataaaaagtcaaagcacatcaggagcacacaaagatctgcatttttcatgagattcattttataaaaatcaaaatttattgttcacttcctatgtgccagaaaccaaacaagaattttcacatatctaattgaatcttcaaaaacacctataaaatagatattattattatcatcatcatgattttacagataagaaaattgaaagttagaaatgtaactttatgaaggtcatatggacagtaattggtggaactgagatttgagtcaaggtttatgtgactccaaagtccattctcttgacttatacattacagtagttctataaaaggcaagtcatttgctcacctattctattccccaaactctctttcaatcaattttatgaagagcctttttaaacccacagttattactcaggtaagtttgaggaacgttcagctgccaccctgctgcaacttaaataatttcctaagtctctactacgactgctgcccctattgcagaaaataaaacaggaaaaacttctagaaattagaattctcgttttattgaaacatcacacaggccaatgtgatgagacaatgactaaggagcaactgcctttgctcttctggattccgtggtgggaactaactttggatcctcaccctgcaggatcccctgctatatgaccctacttgcccaatactccacttcatcaaggtgaagtgacccaccaagagagactttcagggtctgggcattaccaggtagtttctaaatggtaatcaacaagccaattttgctattgatagaagattgtaggatggggacgtgtagaaatttgcaaggtttaaatacatctaattttaaggtttgtggtcttcagtttaacaaaccatctttctagtacagcaatttataatattgactctataatgctggctgttgcaatagtagatcaatgacaatattaagggatgatgagactattccagtttacaagtgtgctgtactggaaagagaacatgtttgaggccaaaagacctgcgatttggtcccagttaatatggcttgcataaactacttaaattttttgtttcatttcctaattagtaaaaccaaacggaaaagataacaaaaaataagctccagggctttttataaataagctaccaatttgaaaatgttctgtaaactatgatgtgttaaacagtatcaggcactgctctgtttaaatagaaaatatgatttagtctgtatgtcatataacattttaggaagcttttaggacttacaaacatcttattaataagtttagaaattttattctcttttaaaaggtgtattttcatgtctcttttgaatttgagtttttcagataaaagatgcctattttattctggctgaaagcatgaacagaataaacaatgagctctgtgaagaatgttctatgaacccgaatcaaactcaaactcctgtgtcactccggtacgcctgatcactggatataaccacgtattggtccagtgagtattcatgtttaacaattaagataattactgatttccactgctatttccattgtcacttcgtaagtcatgcattattggtcttttaatattttgttctcattgaccacagactctaaatcattatatgttagttacagacctttacaatgcctactggcatttgccactggtgacaacaataataaatgatgttgagctgaagctagtaggaatgaatacagaaagtaaaatgataataaataactgtcactccattactaaacagtgcctggttctagcgcatgtgcaatacagcagagtctgcatgatccaagaactaaaaaggcatttactctttagaaacagcaacaacaaaaaagaaatccatttactcatcttgtgctgtgaccccaaattccacactgagcatggcatgagtatttaaagacttctcaacagaatctccttcaatatcttatagtatcttctcaaagtgagagtgtgtgtgaaatgtgccaaaagttacactcagtgcaatggatatgaaattacagcaattacagctagaatgtgacaataatgtctcagatggataagagattgaagatataaatgtcattttattattataaggagtatggaacacagatattagtataaagaatatgggactcaagaatacgagatgtctggtagatattgtaaaacctatctaaatataatgttggttcttgttgggtgatttgggtggggaccaaatctgagctatccttttccttggccatctgtctcataaacttaacttatgagagtagaatctgttgtaataaactcacaaggcagatataatgtaaggggtgttattggtaccaaattatctacaatataaaataatttctcttcaaaatttaaaggaaaatttgtgtcttccccttgtcagacagctgtgacatcctttgctctgtcctctttctcattccattaatgatacatcaggtttattgctctggtggtggtctatctgtttgttttttagtaaaggacttatcataactttatttcctaagtaaactgacatgtggcaatcacagaaggtctgagtctgaagacataatcctcttactacacaagttacataaatttgagccttagtgatcttattagtaaaactggaataatattaatatagcaaatttaatgtaaaaattaagtaaataatatatatggagtaattttcttttattattttcttccaataagcagagtctgagattggaaggtagtttgttttggaaatagatattagtaaacggaactgggagcctgggaagaacgaatcaggaaagaaaggagagccagtctaaagacacagtatcaacatggttactacttgatcctactggggaccctttcaggttctgtggaaaatgcatttccaaattgtccatcttagaaacagaatagggttattggtcaagagttgctctatgtggggttcgtgcctcatataaggttgtatatgtattatcatgactgagcagttatcagagggattccacatagtagttgctagggagccccaatgcaggaagtgaataaaatccaattatttgggatttatgcagaggatatttataagagcagagagtagccaggttgaatataatgttgccaccagtagatttcgtggtcagggatctatcttgtcactaaacagtggtgaggttttcacccagcggcattccgaatgaactggattgtctgagaactgtacgcagcagaacactaatgcaagatgcagagcagtttcagggtagtttccacaacattagaagcagtggcttctatgaaaaattcttaagattcagaatcatagagatcatcaagtttgtaacctataatgggcagccagtcatctagctggcctggcctatactttggaccaagaacaaaaatacaaatgaaaatagtagtaataagaagtttaccatcgtatataatgtggaaatttttgaaacacttccatatgcattatcttatttgaagttaccagtgatgctgtgagaaactatggtattattcatctcatttttcaaatgaataaatttggttttctaaccaagtcttcatcgtctacaagtgctaagccagaataaaaactgaggtgtgtttatcctaattccagcattctaaaaagagccttaattttaacaaaatttcctttggtcaattactttgcaagccttgacacctacactttaccttcagtggcatcagcctgagtgaaccacgcacccacttccctgaaagcaagagcaaagcttacttttagcaaaatgtatttccaattcaatttccactcataagatgtgatctctaccaatgatgccaactagatttgaaggaaactaaatccagatgctgtgtgaccctagacagttttcaacacaaattggctagtagagggctgacaaataacccaaataatctgtaagaaatggaaactcaagaaagtagcatttcccaatatattaccaaatactatctgtctggctatgtgataatggtgtctactcaaagaacattttttctccactgaaatgaaatattcctattaccaaaatttgagataagcaatgtttctgataaaacacaggttttattttcttggctgatatatattatttctaggcaatctgaatgtctgaaaacatggaactttcccaaatttatcttttcccatattatgttttaccatattttctgtattttatagtaaatgagaaaatacttagcgcactgtaaaaacaaatatgtagatgcaagatattattgttaataaaaagatatagttaagctctaatgagatagctttttaaacattcatttcacatatgtcaaagtagataaacaaacaaaatattttacataatatgttgtgggattttaaaaaggcaatcaaaaagaatagtagaaacagaatgtgactctctgcatctgtttaaaattagatatttttcagtgtatttatcttatattacattcttagggaatagaaatccaaaggattctaggtaaaatttggtaaggactaaagttgttttttcttcttcaaatcagtttccacaagccatagattacaatagaatatcaaaacatgtgaggaatatcaacattttttttaaggaaatgtgcactaacactcattgtgacatggagttaaccaaacgggtctttgcttgaaatgtttctgcagagcttgtataacaatatgtctacaaaaacagagtatgcgccagcctttcaatataagtgcttcaacatcagatacaaccataagaggccagaaaacagagggaaaggttaggaatttgcttccatctccaaattttatgtcaccgaatttaactaacttaataataatattaataatgatgatcatgataatcctactattgttgctgctgctattactactatgaatgatagtaactaacagttattgagaagttactatgaactaggcactatataagtggtctgttagttgactcagttaattcccacagtaatcctcatatgaaggatactattagtatctctgctttacaaatgagggaactgaggtacagagaagctaattgactttcccaagtaacactccagaaggaggtggcagatgcacatgcattcccaggaaggcttaggcactgtgctgtactacgtgggtttcagatccaaggtttgttgtctggtctgtagttgcaagcgataagtggctaggatgccaaactttcacagatacccaggcactgggtgggagtaaagtgaagtacaatatctcagagtaattcagaaattagaataacatatttggagttgtgtggtggtggtggcagtggtggtggtggtggtggggtgtgtgtgtgtgtgtttgggggcaggcacaggagaagttattgtagagaaagaaaagtagattattgactcagacgagttttcttctccactagaattcccgagtatatttacaacttcttcgtttcttttttctagtctaagcaaacatgtacatatttcacttttatattcccatgactcctataaagatcaaaagcagtatggagtgattcactacatgacctgaaatggacttactgtgagctctcaagatagaggaaaataattcccctcatgtggtttcccttaatgctaaggcttttctccatgtgcttcacagaactagctccagatccaggagtcccacccattagaggctgcctagattgacaaagggagggcacagccttcagtgacacagtacatggttctcccaccagttgaagtgacataccctatcagttttcccttcggtctgaatgctggtgtgactgcggacctcgtgttcctcttcaaggtcagaaacatcctccagttcctctggggtctataaaaagaaagcaaaacattgctagtgggaatgtaaaagcatttcttctttggaaaacaacgcggcagtaccttaaaagggtaatcataaagttaccatatgacccagcaatttcactcccagttatatactcaagagaaaggaaggcatatgtccacacaaatacgtatacacaaatgttcacaggagcatcagtcatgatagctaacaaatggaaaccaaatgtatgcttactgatgaatggataaacaaaatgtggtgcatgtgtacaatggaatataatttggccataaaaaggagcaaaatactgatacacaccacaacacaggtgaaccttgaaaacatcatcctaagtgaagggagccagccacaaaaggccacatattgtatgatcctgtttacatgaaatgtctgcaattggcaaatctatagcaatagagatttaattagtgtttgctaggtgctaggggaaaggggaaatgggcaatgacagctgatgggtatgtggtttctctttgagatgataacaatgttctgcagttagatagtaggaatgatcacaaacccttctgaatatactaaaaaacactgagtttcatacttcaaaatggtgagttttatggtatatgaattatatcccaataaattgtgagagaaaaagaaagcaaaaaaatgatcacagggaaaattttatttcagtgaatagcaatttggctacccactatgtggttactgcaaaccaagatgcttacagttgataaatgcattagataatcatcattaaaatcatatatcatcaaaatgccaccagaaattatcaagaaattaaaattttagggacttaataaataattcaacttgaaattcagtgtctattataaagagttagctaacttccattccttctttcaatttcagcttaaatgcctctttctcagggaggtgtcttgctcaggaatcctctagactgggctggattccctgccaagtgtttcctagccccctctactttatctgccataatgatcattatactttaatatatcatcgctgaattaggcagctaattgttgaattgtctattctgtgaggcagggacatgtcttccttgtcatttttgcaaatacatgtcaaagtgcttaacaagaattagcctagtatttgttttagtgcacaaggtctcaacttaatatattttttttatttcaatagctttggggatacaagtgggttttggttacacagatgaaatgcatgaatgtgaagtctgagattttagtgagctcttcatccaagtagtacacattgtgcccaatatgtagcttttcattcctaatctctctcccatcctccctgcttctgagtctccaatgtccattattccactctgtatgattcctttgctacaaaatcctggtgacaaacccagaaaataagtatttaggtttcatagaaaacaaccaaaaacgaagtagaagatgtccttgggcctgcatctttcatgcacatatggctgctgaagactggaaatgggcagagcccatctccttagactagctctggtttgccttaaacgttgctttacacacagacattctgtttattgtcagggctgccaatagcctttcatcccttgggagcactccagagatggggacatttgatgattagctcatattatatagcaaaactaccaatttcctattcattaatggcttcagattctttctcatctcatagatctttaaacagcactttctttgttctcacacacttgcactgagcaatacccatccctttgcagaagagcattttgcatttatttcaaccaattcctatcagatattaacatcccccctctcgccaaagccttcaatgtgctattttttatctccgtgttgatctctttgcaatccttctttgctgcaactacatgcagctattatctcaggacaatttattctttcttcttaggtattaatagcacaagttcattacgatgtaatttctatacaatcatatatcgcattattagcctttttgtgcattcttgtcacagtattcttgagaaagcatctttgcaatttccctccttgttatatcaccaggccctataacatttgaacaaattcagttaatcaaattctctttcttgtgccctgttgttttgcaactgaaggctgtctggtgtccctactgtgatctattccttataaatgtctgctgtttattacttgggttatatcctatcatgcaatgacaaataacttcatcatccactcctatagtttattcaacccccaaataaagtaacaaactaagaacaattgctgctatcagaagtcacaagtgccatttttgttggggatgctgtacgaagagataagcctaccatttacacccacatacttctgtgtttttctttgtgtttaacacaggattaatagttttcttgcaaagctacaaaaactgacctcttcttttcatgaacaaaatcagtggggaagtgttcaaaacacttgctggcagcatttcacattctgtaaggcatggtgttggatggtattgtgaaaataaatagttaaatacaaaatgctacagtttaagtggaaactaagaaagagaaaggagtactctaataattttgagggcaatacattaactccttcagcactaaacacaaataatagaaacagcaaatatcccagcactttgggaggccaaggcgggtggatcacctgagtcagatgttcgagaccagcctgaccaacatggagaaaccccgtctctactaaaaatacaaaattagctgggcgtggtggcacatgcctgtaaccccagctgctcgggaggctgaggcaggagaattgcttgaatccaggcggcggaggttgcagcgagccgagatcgcgccattgcactccagcctgggcaacaagagtgaaactccatctcaaaaaaaaaaaaagaaaaaaaaatggggtgggaaaggagggatgatagagtaccctagatcatgccttcttaaaattgtctgcttctacctatctggtaaacatctggaagttttgtgtgtgtgtgtgtttgtgtgtgtgtgtgtgtgtgtgtgtgtgtgtgtgtgtgtgtttctaatcaatttcattctgtgaaagattaactatcttagaggcagtgttatatattagaaaggccctataatattgagtaatgcagacctgaatttgagttctggtcctctaatgagtgattatgggcaatatgtgttctcttttaaagtttgtttccctcagaataaaattcggataataatacctaatcccaaaagttgttgtgaggctcagttacactaagatgctttgggtaagagcttagcccacagacctagctggattgtggcaaaagtttatttctgtttgttgcttttcctcttctttctccactaccttatacctcatcccaatatacacctttatatttttattaaacatttatgtaaatttatccaaattttaatcacctttattccaaatttaataattttaatccagtataatccaaatttatttttgatttggaactttggataagccaccaatgtttctgtcctttagattctacacagacattattttgggttgacatggtacatttactagttgcctctagttacagttacctgagtttgattatctaatgtcattgtgctaaacagggtttaatataattacccatgcactgcttccttctaaaatccatgtaagagatctcttttaattggactttaatcatgtctaacagcgaaattatctcttaaactggcctcagcaaagattcactctagcatgattctcagggatgatggaaataatttgtcttctttaagctgggctgtctctaaaccagacaaagatgaagagagcccattttttcagaaaaagtgttaatcaatgcagacattaacgttatttctcatatcagaattgtggagatatatttcatattttcctattttacctctggcttattatggtgtcttccttaggcagcccaaaagtgatttggaataggcttagtttcttcacctgtaaaatagcacaaatactacctaatttttagggttattgtaaagataaaacaagatgacggactagaacattattcggtgactgggaaatactgaattattaatattgtttatgaatattatagattatcattactgttgctatctcacttgattcaagcaaaagaagccaaaaacaaatatagaagttgaagctgaaaacattcaggctgaggtgtttacatagaagccaggacagcaatgacatagtagtaatacattaagacttcagggtcacaatacatttcatatatatatcctttttcccacaaggagttcaatcctttctatagacattatctcactaatcctttcaggatccctaatgaaacaggtggcattattacaattaaaaattcacttgcgcagactttataaatatttaatattaaaatacaaaaaagaaatttgtggttgctaaattttaaagaagagagaaaaaaacacaggaagaaaataaaaaagaaataaaaagtattaaaaatactgtggaaaacaagagtcatgcttggcttcttctcagaattatgtttgaattctaaaccatacacatgacttattaaaaatataattcactggctagctttcactgacttactaaaatcaaataaccaccacagtaatgtcaggagtggtctcgcactcagagaagctcttaggaaacatgctatgaatgtccatcccaagcaggagactaacgtcacatgttcaatgatttcattccagctgaggtagtaacgtaggatgattttgcaatgtcaaaatggagagatcacaattaaaatacatttaaaaaataaaaatatatcaatgacacaatgccaaaataaagaaaattaagacatggcccttgtttaacacacacacacaaacaaacactgaagttcctgccccacacctttgaccatgagactggcactctaccttataaatattcaagaaatcagtgacatttctgttacactgaccccttttctcctcctcaaacatgtcccacttgtcagcactttccacttaagactctttgtgtctttctatttaccccttcttgcagactggatccttctcggcatgggagctcagatgctctctactcagagaagtctcccctggccagtctaactaaagttaacccttttccccatttcatttatttcttatattagtgtatatattttctttaggtcctttttcatgattttcacctaaaattatattttctcttcatttttttcctttttttggcaggtgggttacattttttattttatccctactagaacttaacttacatgaaaatagggatgttgtttgtcttgttttccactcatgaaatggcacatagtatgtctcaatttttctatttcttagctgaataaaggagcaaacaatttaattactgacaagcttttgttattgatcaatttcacaagaaaatcatgggaacatttttgagctgtggagaatgtataatcctttgccttctgtcttttaataagtattgaatcaataattccttgcctaaagaaaagtatatgcaaatattcttgaattttaaaaaaatcctatggaaactagagatgagattttgtgtagagaaaggttttccataagctcagaagagattctcagatgtggaggactaaaaagtttatgattccataatcagtactaacttgccctactccttgacaatccaatatggataaaaaagacttcagagaaaatgtcatccagtaagcccagaacagtgtttcaaatcttaccatagccccgtgccacaaacttgtcatggaaacagtggtagacctgaaagggttacatgggctgggacaatggatgtctcattggcaaccagtgtgggtaaatgacagggtcggtgagactccctgacatcttgatgcagcccaagcctccagagacagacttagcctcaagagaagtgtttctcagtcttagcattgttgacgtcttgatctgaataattccagttgtgagaatctgttttgtgtattgtaagaagtttagcaccaaccctagcttctatctaccacacacatttggaccctctcaagtcatgagatataattaaatatgtttccagacattaccgaatatcccctggaaatttggaggcttaggaatcacccacttgagaaccattgctcaagaattttggctcacttggcccaacataggtagcaggagtaagggaaggcccaagaatgactatatttaaatttcccatgagccaagttaaaaataaatttacttgcaaataagtatgtaaactgaaagtcatatcccatataataacattatgtttacaagacaaaagagagaagacattttagtcttaaccagactactggaagaagatatcagaaaatgtatgaaaatgagttaataggtgcagcacaccaacatggcacatgtatacatatgtaacaaacctacacgttgtgcacatgtaacctaaaacttaaagtacaaaaaaaaaaaactacaaacttgcttgcagccttttttaaaatttgttttttaaatttttaattgataattgtatatattatatatttatgtagcatactgtgatgtttacaacagtatatattaacattatgaaatgattaaattctaattaacaaatctatctcttcactcatgtatcatttttttgtggtgaaaacaatattcaaaagggtctgggcacagtggctcatgcctgtaatcccagaactttgggaggcaaaggagggtggatcacctgaggtcaagagttcaagaccagcctggccaacatggtgaaaccccgtctctactaaaaatacaaaaaattagacgggtgtggtggcgtgtgcctgtaatcccagctactagggaggctgaggcaagggaatcatttgaacctgggaggtggaggttgcagtgagccaatatcatgccactgcactgcagcctgggtgacagaatgagactctgtctaaaaaaaaaaaaaaaaaaaaaattcaaatcaatatgcctaagagatatctgcacttccatgttcacaatagctaagagatggaagcaacctaggtgtctttcattggatgaatgaataaagaaactgtgagctctccctctctctatatatacacacacaaacatatacactcagtgaaatactatttagcctttaaaaaaaggaaattctatcatttgtttgtcatcttaataccagaatttaataagctgctttcattctgctgatcttgtttttatcttttattcataatgagattatctaaagatatccagtgctaatctaagtttgcttgattatataatcaactcaagttaactcaactaacatattcgattgtcttacatatacagtcatgttgcttaacaatcaggacacatcctgagaaatgtgtcattatatgaatttgtcactgtgcaagtatcatagagtatatttaaacaaacctagatggtataacctactacacacctaggctgtatggtataacccattgctcctaggctacaaacctgtatggcatgttactgtactgaatactataggcaactgtaacacagtggtaaatatttgtgtatctaaacatatttaaacatagaaaaggtaaggtgttgtgtcacgatgttaagatggctatggcatctaatatggtttggatttgtgctccggacaaaatctcatgtcgaattgttatccacagtgctgagggagggacctggtaggaggtgattggatcacgggggcagatttcctccttgctcttctcatgatagtgagtgagtttccatgagatctatttaaaagtgtgcagcatctcctccttggctcttttcttccacctcctgccctgtagatgtgcctgcttccccttcaccttctgccatgattgtaagtttcctgaggcccctccagccatgcttcctgtacagcctgtggaactgtgtgccaattaagtctcttttatttataaattacccagtcttaggtagtgctttataggaatgtgagaacaaataatacaatgtcattaggtgataggaatttttcagttccattatagccttcttaggggaccattatcctatatgcagtccatcactgaatgaaacattgtcatgcacggcatggccgtatgtagacaggaacaattatgctagatactgggaatcttgaaggaaataaaacacaatccttgccctcaagagagataaagggtaagaatattagatggagatgaaagatattccatagagttatatgatttgagactgaagttgagtggttagagatgaaaaaatttcctgggatgtgtcaggcagaagagaggaacgagtgtaaagcacctgaggaaaaactgggaagatatttcttatatcgccagaaagctggtaggcttgtgttacggtgggatattaatggaacttgaagttaggatacttgggtgtcctaactaaactagttgttttttgttaggccaatctcagacttttcctatgcttaaattccttgacctttaaaatgaagatgagaagtaagtaaaactgataatttttgtaaatcctttgaattttcagtttttatgaattgatgcttaaactgaaaacataataaggctgtgacaaacattaggctggatcaaacacctcctcaacactgagagatctcaacgctagtgaagattcggtaaatctgttgagttcagttgattgaaacatagtccactctaattcatcacatcaattcaaaatagggttaatctcctgaatacacatatctttctgttatagccaccagagggagaaggcatctagtattattctcagttttataacccaagtgtctaacggtgcctggcacacagtcagtactcagtaaatacatattttattgagttaatgcaacagaagaataaatgaagatgcaaataagatgtatgtctctatttgtcaaaatcaagaattggtgacttttcttcttacaatcttttaaaatataattcaaaactgcctccaggaaccattagcatccctctattttgttattatttttctttacactattattatcagtattgtattaacatttaatatgaaatctacccttaacaaatttttaagtgaataacatagtattgccaattataggtacaatgctgtatatatagtaggatctttatttatttatcttgcataattgaaatttcataactttggagcagcaactcctcatttcccctcccctcagcttgacaactaccattctgctcatggtttctaggagtgtaaaaacattagttacctcatataaggcaaatcatgcagtatttgcctttctgctaatggcttacttcacttagaataatgtccccaaggttcacacttgtcgttgcatatgactgatctcctttttttttaaggttgaattgtattccatcttacaagtttatcacattttagttaccctttcatctgtcaatgaacacttagattgttttcacatcttggctatcgtgaataatgccgaaataaacatgggagtccagatatctctttgagatcctgatttcaattctttgggacatataaccagaagtaggattgctggatcatatagtagttctgtttttaattttgagaaacctccatactattttttaaagcagttgtaccattctacattcccaccaacagagtactagggctccaatttcttcatatactcaccaacacttatcttttctgtggctgttgataataggtatcctaagaagtgtgaagtgatatctcattgtattttttttttcatgtccatgatgattagtggtactctggctctaagttatactaagcttgagatgaattcaattttcacctatagcatgcatagaagtgtgtcagtggacctgcaagatgttcctaagttattcttttttctttaattgtttgaattaagctctacgaataagcacacctactaaacatgctctgagacagagctgtgagtttatatcctatttccaaattaggaacagaaaatctatggtaagtgacttgcaaaacttcttacaacataaggctggaactatggtagaacataatatctaggattgactatccagattcaaggtcaaacgctgcccttaatatcttgtgacctaaaacaagaacttaacttgttgagaacacagcttcctcagtggtacatgaaaagattggactaattatttataaaatttcagtcatttttattaactttagaattttatgataggtttagcaaggtatcaggaaagataatgaatatctatttcagaaaactttgtattgtcagcatatcctttattcaacatgctgaatacaattttagatcacaaatctcttatagattgttaacttctcaggaaattagaaacagctttttaaacttcctttatgcaggactatgtaggatgatgtgagggttcttcacgcacagcaattgctgatgccattgacaattgtggcaataccattactcttcttgatctatggggggaggtggttgaaaccatgcaataataataagagcagtagtggggggaatgctaaaaatggtggtggcagcagtagtagcaacagtagcagcagatggctagaaacacaccctgaccttcaactcttatgtctgaatgtcggatcaaaaatcagaacaccggtgccatgaatatcagacctattccaatttattttagtgaggaaaatctcacctttttcatcaaactctatagccaaataaactctacatatgtgattttttttatcttatccttagactagacagtaaaagggagtctaacttaaaatttgttcatttttcttttccaaaaatgctattctatagatattaaaataagagtttcagagaatgtctaatagcagagaaaatgcacttgaaatattgttaactgaatatctgtatatatatgtgtgtgtgtgtatatatgtgtgtatatatgtatatgtgtatatatgtatatttgtgtatattcgtatgtatatatgtgtatatatgtatatatgtgtatatatgtgcgtatatgtatatatgtgtatatatgtgtgcatatatgtatatatatatagtctaattatttaaaactcatattgtccgtgtatgtgtgtgagaaagaggaaaataaaatgaaaaatatatatatatcggttgggtacagtggctcacatctgtaatcccagcactttgggaggcggaagcaggcagatcacgaggtcaagagatcgagaccatcctggccaccatggtgaaaccccgtctctactaaaaatacaaaaattagttgggcgtggtggcacgtgcctgtaatcccagcttctcgggaggctgaagcaggagaatcacttgaacccaggaggcagaggttgccatgagccaagatcaccccactgcactccagcctcagcgacagagtgaggctccatctcaaaaaaaaaaagaaaaagaaaaagtaaaagaaaatatatcaacatattttattaattatcatctatgggttgtagaatattataagtgacttttcctcttttagttgatttgtctctaagttgttacaaaacatttttctatcttttatcataaggaaaaaaaacaagcaatgagtgttataggaaaatctgcttaaggttgaacgtaccatttcaaggacgtgtcagcaatacaaaaaggacaagattgcaaaatctgcagtggggtagtatagctggccttgtcaccttgcaataggtctatcaacgttgcatgatatttgaagctgatgtggacacagaaaaaatctttcgattgacaagaggaaaattgcagtgtatgtctttattatcagagcaaacattaaagggggtggtgacagcagatacagagaagtgtcccttaccaggtcccatgctatttccctgttttgtatggtcttttttgttctgtggatgcgtaaaagctgttacttcattattttaggtattacattttcagtgtcttggaaagtggttttacaaaagttttccataacaaagattttgagggaaagagatgttgtggtttgacttcccaatggggaatatagatagatagatagatgatagatagatagatagatagatagatagatagatagatagatagacagatagatgatagatagatagagatagagatagagatagagatagagatagagatagagatagagatataaactgacacgatgtcttttactttcagaaatcgttaagctgccaggtatagtatcaacaatcctaaccaaattcatctggttacatttgcaaagtaatcctaggcacagtaataaagcaaaaaactgcctgctgtgttccagccacggatgttaagtaaggataagcaggacggccaaaactgacactcctatttcactggtcaaaaaaaaatatgaaagaaattacacattactgtaggggggtgttgctccataagacagtaattcagatctatattagacttttggacatattattcaaggttactggattgaagtttgctttatgggacataagaattccctacactgctaaattaaagtagcttaagttggcagcttatatataaaatagaaaactagaatgcgacaaaacaaatatttggacaacacctaaggaagaattatgctctgtatttaaagagatttttaagttccaaaactaaaaggcctatttgtagaggcaagtgaatacatcattgtataagatgtagtcagatataagtggctgtgaaactagctcatggcaaatgcattgtgctgtttctacacagacttgtcctgaccaaaggaattaggacaaatgaggaaacaaacttaatgtggagaattgttttttttaaaatgtccatgtatttcttaacatattaaatattaaatatatacacaccatagaatctagtcattctacttgttagtatttaccaaagaggaatagaaacacatattcacacagacttgtatacaaatatttatagcagatttatttgtaatatcccagtagtgagaacaactcaaatcttaatcaacagatgaattatttaacaaatggtatgcccatttaatgaaatatgattcagtaataaaaaggaataaatttgattaaagcaacaatatttatggatctaaaaataattatactgagtaaaagaagctaaataaaaacacatactgtatgtattagtctgctctcacactgctatgaagaactacctgagactgggtaatttatgaagaaaagatgtttaatcgactcacaattccacaggctgtgtaagaggcatggctggggaggcctcaggaaccttacaatcatggtggaaggtaaaggggaagcaagcacatcttcacatggagcaggagagacagagccaagggggaagcgctgcacacttttaaacaaccagatctggtgagaactcattcactatcacgagaacagcaagggggaagtccgcacacacgattcaatcaccacccccccaggcccctcctccaacacatgtggattacaattcaacatgaaatttgggtggggatacagagccaaaccatatcactgcatgattccatttatataacattctaaaacttgccagtcaatctgtagtggcagaaatcagatctgtggttatttgagagttggtgggaggagtgaacagattgtgaaggggtatgagtaagcttttgggtttgatatatgggttccttatcttgattatggtgatagccttggggttttatacataagccaataaaacatattaaattgtatattttaaatgtgcattttattaaatgttatgcctcaatgctgtcaaaaatgtgaaatgcctatatgaactcttattacatagtgtaacattgtttggcaaaatactatattatatatgctactaatataatatagtatagctgaagttctgttgaataaatacataaaagaagtagtaatgctacaagatcatttttaatcaattaatatacacacttattttctattttaaaaaatgaacttgattttgcagcaggggaccacatattttgttgttgagtaatgaaagatgagcttcagttgagagacaccttgttcatgagtcctctcaccagaggaacttagagatcaagaaacattgcagcttttagtaagcatgctaccaaatgtaggcttttctatatggatgtgaatgtgaaaggaccactaataaggctggcaatatggcagcaaatgtgattctcctatcactttatagtgtttatgaaatatcaaagcaagtttcatttaagtcaatggttttcaaaagtaatttaagtagtaaaaccatttttaataaaattatagaatgccaatattattgacaactatataagagtactatggagctatcctaagtaagccataacaccacggagctggtgtgtgtggatatacagtgtgaagtctggatcatcaggccactggccctgcccgccttctaaagcagcccaagagagagaccacagctgagggaccaccatgctgtgtaacctgggagagttaccgtcagatgtttgattatgtctgactgaattggcatggaccaacttttagttaaacatggaggatttaagaaaattatgcacctatacttcctcttatatacgactaatttgactatagtttatttaaaaatataccagagttaagtaataataaagcaattacaaataatcattgtaataagtacaggtggcatctactggatttcatcagctttccttatgtctttgctttgtcctatttttttttaggaacctccctctctgttactactccctttggatttatccagtagtcttagacgtcaccagggccaagccatgcatatatagattgaaatgttgttttcaaaacctactcaagctatctcttgatgaacaagattagtaccatctgattacaaccctgaaggtatatgctaaagaaaactaataataacatatactattcttaaaatcaatcattctttttacaacatgaccgaaataagtcccaggcactctttagctatgctctgtcctctcttttggaataatcttttcttcccttctaaccgtcaccttatattcttatctttccacctattcaaagtaatttagtatgtcaacaatgttttttctaacattgttctgtcttagaactttttctccctgcagatctcatccactatgcagaaaccagtaataatcatttgtctctgtaaaggtgactttgttttaaaattagttttacaatgagagagctgatctactttggaaaaggatcactgttatcaatgtggcaagatgaaaaagcatgccatattctatctacttggtttaattgaaccaagcatcagcttggtttaattgaattaaccgcaatgactgtgtttgtgtgtcacactattctttttatatttatatttattattactattttttaagagagacagggtctccctatgttgctcaggctgacctcgaactcctgggctcaagcaatcctgcctctgtctctcaaaatgctgggattacaggggtgagccaccatgcccagccacactattctttttaaatttaaagatataaaacattgatttttattaaattttaaaacagagaacttttaaatagatacagattacattcagcaggtattcatggattacctactatgtatgaagtacagtatgctaggtatggtgggactgtcataaattagatgaggataccaccattatgaagctaatgtaacattgcccaagttctgtgtactgttttattcaaaacttcatgaatattgaaacagtgttcacatttttctatcaacatacagtattatttgtaagatgaaattgttaaatttaattacaaagtgttcagtttggtttgttttgctagacaccctacaagctgttcctattactctctctcactctaatgtttacaaattgttatagcttagtgctaaagtgaacagcagagtactcttcaagattttctaggatcttgcagacaaatgtatacatatattttttactcctcatgctgttttatcactttttgatccctcctaggggattaggctgtgtaattgtaaagcttttttaggctttaactatggattatttgtataatgaaaaaataagataacttatattatatattgaactgagtaaggggtaaattcagtcattcttaggtaaaaagacaggataattaggttctcattcttgtttttcattcgttcatgtattcaatcaattttttttattaaataagcactcattaatatgccagatactgtggtagttgctgatgaggaaccaataaagagcccatgtggtatcaaagggctttcctgtctaatatttatttattctgttactctggaaaacttatttggcatctggtttcatatattgaaaaataaagatagctgtctctgccttctttatgttctatattttacctctttctcattgtaaactttgtatggtcaatggagaaggatgtggattcaactctgaatatacactatgtaaggcacacttttcattctcgtgtgaaactagttttataactcagctcagagcacacagtaggttctcactaaaaattttatcttccttctcttttttcttttctaagatggtagtgtagaagataagttgataccatgcacattcaaataattaattttaaattatgataaaccatggataagaagttgtgtagcattaatcatattaaattccttcaattgtgatgtacctatcttatagggttgttgtgaggaatatatgacagtaatgtaaagtactgaatatagtgccaagaacacaataaatgctcagtaaatattagctatcatgtcattctgacttatgtcaataaatattaagtatactgtctagttaatactgttagaattacattaaataaataatgtagaaaatttgtcctggtccagttatctactgactaggtgaccttaattatgtctttttttgttaacttttagagtctagattccttattctgcaaaatggatttattgtatctcaaggcactgtgaagtttgcagtagtaagttatatgaaaatttttaaagcattatgattataaataatatgattataaattggagaacagctgctaacacaattaagaaatttaaaaatattattgcttttttactttcactcacattttgttttgttagataattgaaaacactaagaagtaacttttagagaagctaggttgtacccagacagtgaaagtttaaataagttttaaaaactgaaaactattttctctttaaaaggcatgtataggcaaaaaggaaagtccaaagagaggaaaagaaagcaggagagatctgaaatgacacaagaagtgactcagaatgggaagattgtgcactccttgttgtcccctaatgcacatggaagtatgcaacagaagctgtgaaaataacccaggtgcgaaggccaatggttttcatacatttcaagcttctctccgtgatgtccttttccatgtaaaatctaaatcaggtgtcctatatacataacatgaaatggagatgtaatgcaactgaagctaggaaacaaaaatcttgcctactagccttctctcaaaccagtgatcagaaccctgagttatttctttgagagactaagtacaacacagaagctcaagcatagaaattaagagttaaaattatgtcaagtttcttcactgaaaaagatccctattagcctttgacctaattttgttaatttataatggaagttaacaatcactaaatgttattgcttataaatctctttacctaatttaaaacactgctagttgtagctagaaataggtatttctttatttcttttagctatgtattccttcaaaagaagctccagacttttaaaattgcaccacctcagtatttcctcagtttctttttttaatacaacatacatacacacacacacacactatcttatatatactagcttaataaatcacatggtattttagaacagatcaaaacttggaataatcatgtgggaaaaaagttgtagccaggtgcagtggttcatgcctgtaatctcagcactttgggatgccaaggcaagtgaattgcttgaggtgaagagttcaagagcagcctgggcaacatggtgaaacccctctctacaaaaaattagcaaggcatggtggcacatgcctgtggtcccaactacttgtgaggctgagttggatagatcgcttgagccctggaaaaagaggttgcagtaagaccacaccactgcactccacctgtccagcctgggtgacagagtgagaccctgtctcaaaaaaaaagttgctgaggtttaccaactttttaaaatatttgctcttagacaaccagtaaaattgtttctggtacaaaagatgttcatggtttccttccaattacaaattaaaacatattgctatggttttgttataaatacttaatcacataaatgacaacttcccacacaaccagattgaaacatgacaccagtgttatacttatcaggcagagaatttaaaatactactcttaataaaggctagaatggaaaaacagataacaaacaaaaggtagtgggtaatataaatagagagatgaaaactctaagaaaaaaatcaaaaggaaatataaaaattcaaaatcactgtaacaaaaatgaagagtgcctttgataggcacatcagtagactagacacagctgagaagagaatcagtgagcttgaaatttgtcattacctacttcccaaattgaaatgtgaagagaaaaaaaattacttaataaagagcatccaaggagtgtggaacaattagaaaaggtgtaacatacattacatgtaatagaagaaagaaaaaagaaaatgaagcaaaagaaacattgaaatgataatggctgatcgttttcagcaattcatgatgtataacaaactatagatagatgaacctcagagaagaccaaacgggataaataccaagaaagtacagccaagcatattatattcaactacagaaaaccaaagacatcttgaagaagtcagtgaaaaaaggataagaatgataggatacttataatcagaaaccatgtgtaaaccattttcatactgctgataaagacataccaaagactgggcaatttacaaaagaaagatgtttaatggacttacagttccacatggctaggaatgcctcacaatcatagcagaaggcaatgagaagcaagtcacatcttacatggatggcagcagacaaagagagagcttgtgcagggagaactcctctttttaaaaccatcagatcttgtgagactcatttactatcatgagaacagtgcaggaaaaacctggccccataattcaatcaactctcaccaggttcctcccatgacatgtgggaattgaggagttaaaattcaagacgagatttggttggggacacagccaaaccatataattccaccccagcccctcccaaatctcagtcctcacatttaaaaaccaatcatgccttcccagcagtccacaaaagtcttaactcatttcagcatgactcaaaagtccacagtccaacatctcatctgagacaaggcaatttccttctgcttatgatcctgtaaaatcaaaggcaagttagttacttcctagaaacaatggaggttcaggcattgggtaaatacagcaattccaaatgggagaaattggccaaaacgaaggggctacaggcaccatgcaagcgtgaaatccagcagggaagtcaaaccttaaagctccaaaatgatctcctttgactccatgtctcgcatccgggtcatgctgatgcaagaggtgggttcccatggtcttgggcagctccgtccctgtggctttgcagggtacaggctccctctcgactgcttttatgggctggcattgagtgtggcttttctaggcacagggtgtaaactgtcagtggatctaccattctggggtctggaggatggtggccctcttctcacagatccactagacagtgccccagtagggactctgtataggggctctgaccccacatttcccttctgcactgtcctagcagaggttctccatgggatccccaccctgcaataaatttctgcctggacagccaggcatttccatatatcctctgaaatctaggtggaggtacccaaacccaaattcttgacctctgtgcactggcaggctcaacatcatgtggaagctgacaaggcttgaggcttgcaacctctgaagccatggcccaagctcgacatttgcccctttattcatggctggagcagctgggaggcagggcaccaagttcctaggctgcatacagcacagggaccctgggcctggcccacgaaaccactttgtcctcctaggcctccaggcctgtgatagaaggggctcccatgaagacctctgacataccctggagacattatccccattgtcttggtgcttaacatttggctcctcattacttacgcaaatttctgcagctggcttgcatttctcctcagaaaatgggattttcttttctatcgcattgtcaggctacacattttctgaacttttatgctctgcttctcttatataactgaatgcctttaacagcacccaagtcacatcttgaatgctttgctgcttagaaatttcttctgccagataccctaaattatgtctctaaagttcaaagttccacaaatctctctagggcaggggcaaaatgctgccagtctctttgctaaaacataacaagagtcacctttgctccagttcccaacaagttcctcatctccatctgagaccacctcagcctggatttcattgtccatatcattatcagcattttggtaaaagccattcaacaagtctatagggtgttctaaacttttccacactttcctgtcttcttctgagccctccaaaccatttcaacctcttcctgttacccagttccaaagtcacttccacattttcaggtatcttttcagcagcaccccactgtactggtaccaatttactgtattagtctgttttcacactgctgatgaagaaatacttgagatggggcaatttacaaaagaaagaggtttaatggacttacaattccacatggctggggaggcctcacaatcatgaaggaaggcaaggaagagcacgtcacatcttacatggatggaggcaggcaaagagagacagcttgtgcagggaaactcctctttttaaaaccatcagatctcatgagactcattcactatcacaagaacagcacagaaaagacccaccctcttaattccatcacctcccactaggttcctccgatgacacatgggaattgtgagagttacaatttaatatgagattttggaggggacacagccaaaccatatcaccaaataagagagtagagtaaattttttgaattgtcaattaggaaaaagaactctacatttctacacacagcaaaattattcttcaaaaacgaagaagaaataaaaactttctcagacaaacaaatcttggaaaattcatcaccagcacatctgcccttcaagaaacattaaaagaagttcttcagtgagaagggaaatgatgtgttagaaacttagatctaaaaaaagaacatcagagaagcactaaatgaaggtaaaattaaatctttttttcttatttttaattgatctaatatgtaacatttgttcaaaataatactagtaacaatatattgtatgattgtagcattgaggtaaattaaatgaatgatagcaatattataaagagttgaggggaggaattgagaatactgtattgaaagatgaccctactacccagaaagcagttttatgaaagtggacctaattgtaaatgtatattgcaaactctagggcaagtactcagttttttaagaaaagtataagttatatgctgacaataaaaaacaaaatagaaaccatatgcaatgattaaaactagagaaggtagaaaagaaaaaagaaatgaaaacaacagaggtaattcatagaaaacagaaatactaataatcactttaaatgtgaaaggtctgcagcatcatttaaaagacagagatgttcatgcttagaatggagtattcttcataaatataaagaaatgaactatcaagctatgagaacacctggatgaactttaaatgcttatagctgggtgaaagaatcccacctgaaaaggctacagactatatgatcccaattgaacagtatgttgaaaagaacaaaactagaggaacagtaaaacaatgagagactgccaatgattcaaggcgagaggaggaggattgaataggtgaagcgcaggccttttttgactggtaaatcaattttgtatatattaatggtggatacatgacatacctttgtcaaaagccatagaaatttacagcacaaagagtaaacctcaattatgtaagttttgaaaaaatcatttaggagggctaggatcctaggaaagaatgcaaagtttgacaacattatttacacatgttctgattgtaacaaataatctcactgtatggggtatggagagggaaaagttgctgatctaataaactttgaaaattaatgtaatccataagactgaagtcaaaaggaattaccagtaagcaatatgctgcacttgataaagctactttccataagggtacaggttaatgattctcataatgttatactagtgtactgaaattaaacagttaggtaaacaaatgatggtgatgggagtcaggtttttcattgttagaatagaagtttatagatgaacaagggaagaaggctagaatataaattcatgtttagctaaatatagatacagatgtagaaacatttatggacatgtggatttaccttagttagtatgcacacatatattcccttgctctgtcagctgtcacctaaaagaaatgacaccttagcagcaacaagcatggctgacactcagattttggtttctgataccattcaccaataaaggggccagggctccttagagaaatgctaattctacgactgggaaggaaatatatagaaagaacctgaagtattagatactgccaaaaaataaggaagaactaaaaaatttaaatctgcaagtacacactgaaagagttgtcaatagccatatctggaataatttgagcagtaaaataaacaaagcaatatggaattctaacccaatgtataaactaaatatccataagtccatagtgatagaaataaatgactgaatatataaataaattgaagaacatatacaaatataccctgaaaagcaattccaagtaaattccaaataattccaaagtattatatagcctgccctcaaggagcggaaaataacttccactccttaactgtgggctacatagtgacttctgtccagggtagagtgtagaaaagggggaaaatggccgggcgcggtggctcacacctgtaatcccagcactttgggaggccgaggtggatggatcacgaggtcaggagatagagaccatcctgctggctaacacggtgaaaccccgtctctaccaaaaatacaaaaaaattagccaggcttggtggcgggcgcctgtagtcccagctacttgagaagctgaggcaggagactggcgtgaacccaggaggcggagcttgcagtgagctgagatcgcgccactgcactccagcctgggcgacagagcaagactctgtctcaaaaaaaaaaaaaaaaaaaaaagggaaataaactttatagtgtagatactacaacctcagccaggtcatcaatgtcaacatcaacagcaatacctaatatcaatacttgaaatgatatgataaaaatggtactttttctcactggtcttcctcccaaaaccacatattcccagactaatcataaggacaaactcacaaattccaataaagtgacatcctacaaaatctcttatctgtattcctgaaaactgtcaagttcgcaaaaacaaggaaagtctaagaactgtcacagccaagaaaagactaaggaggcatgactattaaacgcaatgtaatatcctagatagagggctaggaaaggaaaaggacatgagataaatactaaagaagtctgaataaatcatgaacttaatattacaatgtgcacttattaatttttaacaaaagtactatatgaatgaagatgttaataataagggtataagccatatgggaacgctatgttctatcttctcaattattctgtaaaactagaactgttttgcctgtaattccagtactttgggaggccgaggcgggcgaatcacgaggtcaggagtttgagaccagcctggccaacatggtgaaaccccatctctaataaaaatacaattagctgggcgtagtggcagacgcctgtaatcccagctacttgggaggctgaggcaggagaatcgcttgaaactgggaggcagaggttgcagtgagctgagatcacaccactgtcctctagcctgggtgacacagcaagactccatctcaaaaaaagaaaagaaaaacagttagaactgttttataagataaagtattttcttaattcaggaactaacaaggtagaacattaacatacaaaagttactaatcttcatatacacaaacaataatcacttagtcaatatagagaaaagaaaataatctgtttacaaatgcaatagaaataacaacttatttaaaaataaatttggaaaaaatgagctaaatttctctgagaaaaactttcaaatatgccaggtccacataaaaacctgcacatatatttatagcagctttattcataactgccaaaaattggaaggaaccaagatctcctttggtaggtgaataaatagatatactgtggtacatccagacaatagatattattcagtgacacaagcatgaaaaaaaagctgccaagccagaaaaagacatggaagaaacttaaatgcatattaccaagtgaaaaaaaaagccagtcggaaaaggctacatactgtatgattccaactatatgacattctggaagaggcaaattatggagacaataaagatcaacagttgccagggcttagagggaggggatgtataggcagaacacagaaggcttttagggcagttaaactactttcattacattatgatggtgtttaatgtccaaactcataaattatacaaccaagaatacaccctgatgtaaggtacagattttgggcaaaaattatgtgtcaatgtaggttcaccaattgaaacaaatgtacccactctggtggaggatgttgataacgggaaaggctgtgtgagtttgtgtgtgtgtgtgtgttgtggaggctatctctgtaacttttattcaattctgctgtgaacctaaaaaatagtctgtttaaaaaaaaaacaaaaaacaaaaaaaaaacttggctgggcgcagtggctcatgcctgaaatcccagcactttgggaggccgaggaggacagatcacctgaggtcggaagttcaagatcagcctgaccaacatagagaaacaccatttctactaaaaatacaaaattagctgggcgtggtggcatatgcctgtaatcccagctactcgggaggctgaggcaggagaattgcttgaacctgggaggtggaggttgcagtgagccgagattgtgccattgcactccagcctgggcaataagagtgaaactctgtctcaaaaaacaaaaacaaacaaaaaacttctattaaggtacaggcaagcagcaagctactctcacattgggcctctggaatactggcaggatgaaattcctcaaccaccatggcattggagttgccagggaaagctgcttagagaagtggtaggatcagaactccagccagggtggagcccagagggtttggtgtgggattgtctgtagtgcagcatggccagggacacccatcaccttaagctcgacttgcttccataggagactttagccataggagaactgttgaacgtgaactctgcagggcggtcttgcctctgagatggggttgattagacctgggcaaccctcagtctactggcctcttctggggccccagcctggccgtgcctgcttgcagtgcagcccccaggtacctgtgggtgtctgcatcatagctcctgctcttgtggactgcacctgataagcagagtgctcctgcagagtggcccccaagacacacaccaggccatctgtgtcctcccctcactgcagcctcccccagccactgtgcctgcatgaacacaccataggcacccccccacatcacttagccagtgcctatgtgtgcccttgggttggatcttgcttttacttccccgacagtgcacatgaaccctgcactatgccatgccactactgcctgcatgagggtaccccaccacccttctccccaccacaccaccattgtcctaggagcattggcaggcatgaaacctgcctgcttcacctctgccagcatcctgcccctgtgccaacactgccatcagtgctaaactaggcacacagaacagtgacctgcccccagccctgagcggccaccatgccagcatgaacacatgcagagggcacacatagtcctgcacccaccacaaacatacaacacaccataatctctgggacatagctaaagcagtggtaagagggaaatttgtagcactaaatgcctacatcaaaaagttagaaagatctccagctcacaacctaacattacaattaaaggaactagaaaagcaagagaaaacccaccccaaagctagcagaagacaagaaataactaaagtgagagctgaactgaagactgagacacgaaaaaccattcaaaacatcaacaaaatcaggatctgttttttttttttggaaaaattaataagataaactgctagctagactaatgaaaagaaaagacagaagatccaagcaaacacgatcagaaacagaaaggggaatattactactgactccatagaaatacaaagaatcggccgggcactgtggctcacgcctgtaatcccagcactttaggaagctaaggcaggaggatcgtgaggtctcgagttcgagaccatcctggccaacatggtgaaaccctgtctctactaaaaatacaaaaaacgagccaaaaaatgagcctggcatggtggcacgcacctgtagtcccagctactcaggaggctgaggcaggagtattgcttgaacccgggaggtggaggttgcagtaagcccagatcgcaccactgcactccagcctggtgacacagcaagactccgtctcaaaaacaaacaaaaaaaaaaaaaaaagaaagaaatacagagaatcatcggagactattatgaacaactctatgcaaacaaactagaaaatctaaaagaaatggataaattcctggacacagacaaccttctaagactgaaccatgaagaaactgaatccctaaacagaccaataatgagctctataattgaatcagtaataaattgcctaccaaaaaaaaaaaaaaaagaagaagaagaaaagccctggaccagacggattcatagctgaattctaccagacacacaaagaagagctggtgcctttcctactgaaacttttccaaaaaattgtggaggaggtgccccctcttcaactcaatctatgaggccagcatcatcctgaaccaaaacctggcagagacacaacaaaaaggaagacttccggccaatatccttcataagcattgatgcaaaaatcctcaacaaaataccagcaaaaatccagcaacacgtcaaaaaactaacccaccacaatcaagaatgctttattcctgagatgcaaggttggttcaacatatgcagatcaataaatgtgaactaatgaagaaaacattccatgctcaatgatcacactgcacaaagtaataatttgtagactcaatgttatttctatcaaactaccaatgacatttttcagagaactagaaaaactattttaaaattcatatggaaccaaaaaaaggcctgaatagccaaggcaattataaacaaaaagaacaaagctggaggcatcacattacctgacttcaaactatactacaggactatggtaacaaaaacagcatgatactggtacaaaaacagacacacagaccaatggaatagagaatagagagcccagaaataaggccgcacatctacaatcatctgatcttcgacaaagttgacaaaaacaagcaatggggaaaggactccctattcaataaaaggtgctgggataacaggctaggcatgtgcagaagactgaaactggaccccttccttacacagtatacaaatatcaactcaaaatagattaaagacttaaatgtaatacctaaaattataaaaaccttggaagaaacctaggcaataccattcaggacgtgggaaggggcaaagatttcatgacgaagacactgaaggcaattgcaacaaaagcaaaaattgacaaataagatctacttaaactaagagcttctgcacagcagaagaaattatcaacagagtaaacagacaacctacagaattgaggaatatatttgcaaattatgcaaatattttctgacaaaagtctaatagtcagcatctataaggaacttatacaaatctataagacaaaagcaaacaatcccattgaaaagtggacatgaacagacacttttcaaaagaagacatacatgcgtccaatgagcataggaaaaaaagctcaatatcactgatcattagagaagtgcatatcaaaaccacaatgagataccatctcacaccagtcaaaatggctattaataaaaagtcaaaaaataacaggtgctggcaaggtagtggagaaaaaggaaagcttatacactgttggtgggagtgtaaattattagttcaaccattgtggaagatctgattcctcaaagatctcaaaacagaactaccattcaacccagcaatcccattactggatatatacccaaagaactataaatcattctgccataaaggcatatgcatgcatatgtttattgtagcagtattcacaatagcaaagacatagaatcaaactaaatgctcatcaatgacagatttaataaagaaaatgcagtacatatacaccatggaatactatgcagccatataaaagaatgagatcatgtcttttacagaaacatgaatggagctggaggacactatccttagcaaactaatgcaggaaccaaaaaccaaataccacatgttctcacttataggtgggagctaaatgatgagaactcatggacacaaagaggggaacgacagacactggggactaccaaagggtggacggtggcaggagggagaggatcaggaaaaataactgttggttacttgtcttagtacctgggtgatgaaataatctgtacagcaaacccccgtgacacaggtttacctatataacaacctgtacaagtaccccagcacctaaaataacatttttttaaaactccagaacatacaaaatgtacttgaaaaaaaatagaaaggcaccccatgatctacaaataaacatcacaaatatgtaaattctcctatgttaatatagttgaatcctatcctaataaaaatactacaagatacttttctggaataaaacttgtgggaaaaatatctagccatgtgcagtggctaatgcctgtaatcccagcactttgggaggccaagacaggtggattacttgaggtcaggagttcgaaaccagcctggccaacatggcgaaaccccatctccactaaaaatacaaaaattagccaggcgtggtggcagccgcctgtcatcccagctatgggggaggctgagacatgagaattgtttgaatgggggttggaggttgcagtgagccgagatcacgccattgcactacagcctggtcgacagagtgagagtctgtcttaaaaaaaaaaacaaaaaacaaaaaacaaaaaaaacagaagaaagagagaaataaagcgagaaagcatctaagaatatcctggaaaaaaaaaaagtcgatgaagcgggattagcccaattagaaatgaaaatatacactaggtgatctgaaatcagtctatactggttctcatatccacagcacaatgtaacaataaaagaaagtctagaaataaatctatatttggcaggtaataaggatgaaatctcaaaaatgtttgaaaaaggtagacttttttaaatgaatgaggttaggaaaactgtatactcattaggcttgacataaaatggatgtgaacaacatactctatagcagaataaacttcacatgaatttttaaaaatctaacttaatagaaaagtaacatacagaaatagaagaacatctggataaattatttacatcctcatttgggtaaactctagcaaagactcaaaatgcaatgcaatgaaataaaagattgataaattcaactacaggcatattaaacattaattgaatgacaaaaacaccacagtcaaaatcaaactataaataattagaagaaaatatcgacaacatgcaactccgataaaaagctaatatctctaaatgtataaaaaactcataaaaaccaagaaaaaagaacattaaagtgatcttcattttaaataagaggtattaagactccacaaatatgtcatttccaccctgttagactagcaaaaaatttaaaatcttaataatacactctgttggtgtggctgtggagaaatagcactttcatgcactggtggttagattgtaacagttattttttctaagatacaaatcaatctttggcaatttctataaaaaatctgtatgagaagttcattatttgtagatattatagaaaatattaaaaacaaattacatggtttactatgtagtactaaaaataagatgaggaagatttgtatgagataattagaagtgatattcaagatgttcaattaagtgggaaaaacaagtataagaatatataggtatcagaagcattttctgtatgaaagaaggaaatttaagaatatttgctttcaaacagaaacatagggtagataattagtcattaaccaaaatggttaactacaagatgcaggtgtgaatggatgaaagaattaagaatgggtatcagacttgtgcaagcatgcgtttgtatctgtggtgattttttattcatataaaggtcaaaatgtcacaaaataaatacacatttttaagacagcaaaccataaattaaatataaaaataagaattgatcctaatagttattaacagagaaaaacaaagatttaagtcaaggaaattttgatcacagtactctgtacactcttggttggaaatattataacaaaagaatcttgaactttacatggtaatggtactggtaaaatgattctgaaaatattttgtgtgattgtagatagagtgaatgtttaaagatattgttgtattggagaactagaattcttaatgtaagaagagatactgaactggaatgaaaaatgataagaaaatattcttgatcttatatttgaataagaggtattatttttcataatgcaatatttcttagctagtaacagtaaaagaatgacacctcaattgcaacaaaaacacataacaccgaggttttgatgactaaatataattcttcactacaaggaactagaactgtttggagatatggttctttctggctaaggtaatgtgtgcaatgaacgttgaatattttgttgggcgagaaggcaaaaaaactgccccaaacctagagatcatgactaaaaacacagagaagctagtttaaaagttctcccctaaaaatgtttgggacaaattagctaaaaaaattaatgatttcagtagtgttaatgtattaaatcatttcatcaatcccatctgtaacagtgagagagaaattgaaacagcttttctttgtagaaaaatcacagctaaaacatatagaaagaataaaataaaatcactattttgctaccagtaatgtactaattgattaaagcaagaatcatcaatggatgctaaattcattaggtaaaagtgttgttgaacaacaaggatgttactatgatctctaagtatcctcaagcagataattaagaacaaaagaaaaagtgtttcttcacaatgcggagatattgcagacaccgcctttactaagtaaaacctatctatcattactgaaacaaaatagcttgcatgcactggtgttctgctaaatgtttaacaattgactctaaaacacatgcatataaaaagggcaaaatgcttatataatatttacaaatattaatagaaacgatatgtaacacaattttttttttttttttgagatggagtcttgctctgtcgcgcaggctggagtgcagtggtgcgatctcagctcactgcaagctccacctcctgtgttcatgccattctgcagcctcaacctcccaagtagctgggactacaggcgcccaccaccacgcctggctaattttttgtatttttagtagagacgggggtttcaccatgttagccaggatggtctcgatctcctgaccttgtgatccgtccttctcggccttccaaagtgctgggattacaggcgtgagccaccgcgccaggccacgtaacacaatttacaaataacatataatactctttattgtaaactgcatataataaatcaattctcaaagaatattttcagttttattgccaaattgtcttcaattcatgttttggttgttaagtgatgaataagtgtagttctaacatggatgttggttaatatgtttgtttaccttaatgagtaagaccaacaaaaaacaataaagatgtatgccagaacttaatcatggcataagctactttttactaaattggataatagttttcaaacactaaatagtaatttcttcactttttttttttggtgttacaaggtaattgttatacacacagcaaaatataagtttagtctacattattaacacttttctccatcactttctgacaatcagtatcataaaccatgttctgatgtgtagcatttgccaattcttgcaatgtaattactgcacaatggcctacttccagctattaatgtgacatcactgaaagcggagtttagaagagagcattgtgttgtattatctccatgacagatgtaaatttggtaaaataattaagaaggaatgaaattttagtatctattacatttgcttaatacttattatttgtgagttcacataattttttttttttgagatagagtctcactgtcgcccaggctgaagggcagtggcatgatctcagctcactgcaacctccacctcgtgggttcaagcaattctcctgactcagcctcctgagtacctgggattacaggtgcgtgccaccatgcccagctatttttgtatttttttagtagacatgggtttcaccatgttggctaggctgttctcaaactcctaacctcaagcgatctgcccacctcagcctcccaaagtggcttgagccaccgcgcccagcctagttcacataatttaatgtttaataatgaccatgtttaacaactagctcagagacttcttgagacttttttttagcaatcagcttccagcaaaccactgctttgacgtgactcctgtgcaacgcaatgaggatacaatatcagcttcatagcacttctacaaaagatatttaatcttttaattataaggaaacaatcaggaaaatccagaatgttagatattcaaaaagccctctagcttggaatcttcaaaattataaatgtcatggaataccaaatgtaaaaaaacaaagtaggaggactgttctggattaaagaaaaccaagaggcatgacaagaaaacccaatgcatgaatctcaattacatacaatggcagggggcagggacagaaaaaaatttaaaactaaaaacaatacttagagaaatttgaatatgaaccatatattaaataatacaatatcaacattaaatctgttaagtataataatattgaggttatactggagaatgccattgattttatgagatacgcggaacagcaaaaataagtttgtggactgggtttggtgcctcatgccttaaccccagcagtttgggaggctgaggtgggtggataacctgaggtcaggagttcaggattagcctgggcaacatggcaaaatcccgactcaacaaaaaatttacaaaaaagtaagtgggcatggtggcacgtccctgtggtcccagctactctggaggctaatgtcgggggatggcttgagtccaggaggtggaggttgcagtgagccaagattatgtcattgtactccagcatgggcaacagagccacatcctgtcttgaaaataacaacaaaattttgtgcatagatatataaataacaataaatgatatatatctatatagagaaaaaacaaagaaaataaaatagtaaaacttattaaatctaagtaaaagaacaaaattactccaaagaaaaaataaaagcccgcagtctttgaaaagtatatgaaagaaataataataaacccaaatatatgtatatatgtatgcattaaatttaaaatttgcattttcaaagacaaagtttgaaactttctccttgaatccagaacaattattttagttgctatttattgagcaacaggtgtggatcaagaatctggcaatttactttatctatattatctcaatgcctccaaccacatgatgacatagtaattcttattgttacagataacaaactttgaatactgactatctttgggcaatgatatcatgctatataaccaacaatccataatggtcaaagaaaaattgtttctatatggccttgtattttgttgaggcaaagaaaacaatagtaggcttattcatgataattctttatgtattttgctcatttgatgataaaaatccttatttaaaagacgaattgggctgggcgcagtggctcacacctataattccagcactttgggaggccgaggtgggcagatcacctgccatcaggagtttgagaccagcctggccagcatggtgaaacccggttggtttcacttctaaaaatacaaaatacaaaaatattaaaaatacagaaatcagccaggtgtggtggcatgcacctgtaatcacaattacttgggaggctgaagcagaagaatcgcttgaacccaggaggtggaggttgcagtgagctgagattgcaccactgcattccagcctgggaacaaagggagactgtttcaaaatgaaatgaaatgaaataaaaataaaagatggattgacaatgatcaaacatctggacctttacacatcactctctctaaataagagtaatttaacattggtcttcatttcttcacaatttcaaatttctgcactatatgaccaggaaagccaaagtttcccccaggctttctggtcatgttgtttgcctctgccctgtgtgatttttctcctgactcaatgaagggaattctaaaatctgacagattagcaatgaaatcttttacaccatttcctaagattcctcttagatttatggctgcacgcttagggatatcatgatgccgaaatgttaggcgagaaataaaactatattttcccctttcttacttcagtggagcacaatttccatttattcacactgtatttcctcacacaatatgttcttcccacccaaggctataaatttgaaaatatttataggcaagattacccctgatgccatttataccttgatggctttgtgtttcagctcctaagagccactcatatgtcatatgaatggcttacaaccatgtactgccttggatttttccctgtcaaatgcaaggcccttctttgactacaatactcttgattcaatttattattaataacacaccctgctaatgacttcaaagaaagcctctttatgtgtgttcagaggtttcccaactcttgctttctaggttttacaagtcacttttagattttgagagtgagggttgtgttccccccttttctcctatatgtatttttataaaaatattcaaattatgacatttctcacactacaatagaccatcataattgtccctctcattgtgtcatatttttcaagtgaaggacatggacagacactgcaagcattatacagctctgggcgggaatcaggcagacaggcctgtagtttgtacatagaaatccagcctcagtcatcctgagatgatgtttaggtcaaacaagaagggaatatcctgggttgaactccaataaagagactttgccttcgtccggttctcccttttcctgatgattttgtaaagggactaggaggatcaactgggtatgtggcaatgggggcttttgtggttttgaaggtggcctcattagtgaatatgagtatcttgtaactgcacgctccatgtctggcatgttgcatagcaatcattaaagcagctataaaactttcagatatgttgagattttgagcagctccatttatgcacagagtagggaccaaaattctaactaactaatcgccacataacatgaagagagcttagaaatcctaaagagagaaaacctattagttgttcctcatccttcaaatttttgcaccaaaagcagagaaccagaggaaatgcaatttaacttaatagtaaacccccttcaaggagattaattaatccctcctcctttcaattctttccagatgaatgttgttaagtaccaatgtaatcgtatctggtatctttgaggtatagtgaactctgaggaaggtaatgttaagatgcatttcaagagtataaacaatccacgagcaaagtagagaaaaaatttagtctcctgacattttataatacaattaacctgaagaacagagatctatgttacgatttctctaattttatctttctaatgatttaagccctattcataatgtcgttaggtattggggtttccatttgtctttatgtatttgttctctcctagcaataaaatgacctattgtttattggtcactgttgaacaacatacctgaataactctttaggaacattctgtcctattctgcaaatcccacattgcatggctaaaaaggaaatgcagccaactcatttgtaaaagacctatgtgaggaagtgccagttgttatttttaaacaatttgttataacagaagtagttctgacttttcttcttaattgcttggatagttcatggagagtatcttctctcttactttagtctatgcttctttatgtttttatttaagagattttgtcattgttgttgctgttggttgtgatgatacttgaggagaagcagggtttaagaaacatcataatctaagaacatttcaatagaaaattttctgagtctgggtacactggctcacgcctataatcgcagcactttgggaggccgaggcgggaggatcacctgagctcaggagttcaggaccagcctgggcaacatggtgaaactccaacactactaaaaaaacaaaaattagcctggcatggtggtgcatgcctgtaatcccagctgctcaggaggctgaagcatgagaattgcttgagcccaggaggtggaagttgcagtgagcttagatcatgccacttgactctagcctggcaatagagtgagaagactctgtctcagattaaaaaaaaaaaaagaaagaaagaaagaaaaatttctgagaaaatgtttaattgcagtatagtttgcttaacagtaattagtttaatatttaaaatttcaagaatgtttgaggttaaaatttacattaaagaatattgttatttataccaaaaaaaagcaaagagatgactccccagaatttaggattgaatgaagatatcctcaaacagttaaacaattgttaaactgtaaaatcaacatataatttgccaagatcagagacataaaaattctccaattatggagaaaatctccatcctaagacagatgtatcttaacttgcctcaacatatttaagtgagatttggagggatgaggtacagataaatatagattaaagttttattgtttttgtcatactccagtgaattgattttatataaacgataaataatttattcatctgatagtgacaaaatatccccaaaataacagcacatataagagaggttgacttaaaattgtacttagagagtcactgaaaacagtaaaacaagcaaaacactgtctattcgaattcaagcattgccaacaaattgatgataatgtgtattctgaggcagatgtttccttatagagaagatggatagcccaggttattaaagatatatcccatatgtctttcgcaattattgtctccatgtctgtggattctctttttattctcttgaaagtgtctttcacagagcagaaagcttacattttaataaagtccagcttatcaatgctttctttcatggatcgtggctttggtgttgtacctaaaacgtctttgccaaagctgtttacctagatttttctcctaccttttagaaatgttataggtttgtatatttatttaggtctttatccatttttagttagtgtttgtaaagcatataaagtctgtgtctaaattcttttcatttgtttgttacatgtagatatccagttgctccaaaaccatttgttgaaaagactatcttttcaccattgttttgccttgactctttcatcagtggtcagctggctttatttagttgggtctatttctgggctctgtattctattccattgatttatttgtctattatttgaccagtatgacactgtcttgattatggaagctttatggtaagtcttgaactcaatgttggtcctccaacttttttcttttctttaaatattgtcttgtctattccaggtcttttaactctacatatatactttcaagtcattttgtcaataaaataactttctgagattttgattgggattacactgaatgtgtagatcaagttggaaataatagagccagttttgaaacaggatttaaacaagatctgttcagctccaacattaaccttttgctatgacactgtgacagcaattaaacaaccataaatcacaggttaaaactgatatatttcaaagacattttaagaattagagacctcaccacaatgcataatacttgtttttgggtagttttcttcagtgaattctaatgctataggtattactggcagaaattttctaggaaaagagcagagtataaaaataataaataagacaagcatatggaaagaaaaagtcagttgcagaggaagaaaagttaaaaggattgtgtctttttaaggcggtgaataatacttagtagatcatctcaaatgtttctgatttctggctctgcttccagaatagcaatccattttaagcagttaaatacactaaatttctgacagtgtaatatacaatactttatgtattttattggaaaaatattttaatatatctggtctcatatatttcctaatagaatataccaccaccattattatggaactcaattataaaaatatgaaccatttgacagaaattggctatcctgaaaaattggaatacatatgcattattgatcaaaatatgcttacagtaccaaaaaagcatagagttagttcagtgtttttaaagcttgatattatgataccaagcaatagccgctgaaatagaaaggagtatactttataaaattaaaatcaggtttttaaaaaattttcttcagagggctaactggtccataattgtttttaagtttcttgctgaaaaattgaaataggtcccaggagaacttatggcactgataaagtaaaactgtcactttccagtttggtcgtcaaatatatcatccctctgtctattacacacagcagttctgccacaaatcttgtttctactcacaattaattaagcaaaactaaaatgtttaaagctaccacaaatcaaatttaatttaaatggctacaataacttaaacagagataaatgaaatgactttcttatgcttcattacttcctctaattccttttaaaacatttctgtagaagaagttctgaggatgaggagacaggggtggaccaatgagatttcaattaaactaccaaagtaataccttaaccgcaggtggtcccaggaccagttatttccacttattccattccctttgccacacagacactttaatgtgaattttaaagatatatatgttacaattttcagagtctgatttatcttaaaactttaaaccatatgacatttctaatgtaaaaatgtaatcttgatttaggtgcttaattaaaaggatggctgctttattaataactcaattataagtttaaaatatgtcatagtataatctaatgattgtactgttttcccccatgggacctttaaatacacacaaaataattctatgccctgatagaattctattttttgttgttgctaagacaatttatttttgttatttcgtgacttcactgcattttattgcatttctgtgatttctttttttactgcagcatctctaaaatctcttcttacagtttgggcatagaattgagagcaaaatggaatttatcgcaactacctcatgcattttttcttaaattgaaatcagattacacaaatacttatgttttgtttccatggttatgcaagaaaatagtttttcagtcacttatacaaatctatgcagaatttatacatgtattgcttattttattttatctttttatcaaacttagcatgttaggaaacattactaaattctgaaaatgttaggaatttaattaataatgtatttgtagcctcgaccatcttaagaaaaatatatggtgttggctggttaatttatatttatttatttatttttttttttgagacagagtttcgctcgtgttgcccaggctggagtgcaatgacataatctccgctcactgcaacctctgcttcccgggttcaagtgattctcctgcttcagcctcctgagtagctgagattacagggaccagccaccacacctagctaattttgtattttttagtagagacggggtttctccatgttggtcaggctggtctcaaactcccagcctcagatcatccacccgcattggcctcccaaagtgctgggattacaggcgtgagccatgacacccagccttctatttaattttttaataggcaggcattaatgtcagttaatgctatataaaatgacatatatggagaagtctcaataccaaaattgccttctattccagtatccactccccttccacatatgcatacttttagggaactctataactagtttatttatttcagtatttctcttaggaaaatgtaatgaaatgcatatttgtatacccctacttttgtataaaaagtagcttctatattatgcatatacactattctctcccttgctttctttaataatatttccttatgaacaactcatatcagtatatagacatcttcattcataaaggagaccctacaaactactaagtatttattactagttaccaggaatcaaaagaatagccttttagccatcctttgaagtatatccatatgccgttcaagactctaaaacctgtaagggctactccacagctctagcacatggctttcctttccaaggcccttctccacacaaagacaaaggggaatgtacattagcaccatatcatgtacaggtaaactagagtggaatagagaaagcctacagatatggaagtagcagagaggcccatgaagctgtccttatgccccagagaggtttgctttgccccagtgggcatagttgctttaaatatatcattgaaaggactccaggaaagagttcctgacacccaaatatctctatatatcatttatagagaaagtggggaagggtttctctactctaaatgactatgtaaaaataggtccttcttggtgaagaaaatggtcttgtggaaagaggtaaccactggttctcaatgcctgataacagcagtcattttcattgcactaacttggacctgctgagccagcttattgcaaagcaagtaacagggaagggaatgagcctccagggtcatctgggtttgtttctcttcattaagtgttttttattttttttcataagcattgctgcttattcatagatacacatagagatgcagaatcaaaatgagacatgaatgctggttatcagctgcactcactcactaagtggctttccttctttttcttttgagatggagtcttgctctgctgccaggctggagtgcagtggcatgatctaggctcactgcaacttctatctccccggttcaagcgattctcctgcctcagcctcccgagtagctgggactataggcacgcgccaccaagccctgctaatgtttgtgtttttagtagagacagggttttaccatgttggccaggatggtcttgatctcttgaccttgtgatccacctgctttggcctcccaaagtgctgggattacaggcatgagccaccgtgcccggccgaagtggcttttttatatctcagctttatactatgaggtgaaaatttgagtcttagtaaaattcaaaatactggcccttccaggtcattttcagatggctgaagctagtcaaaccaggagtagcaactgcctctactgaataaaatacaacagtgtaaatctaatataataaaaagaactagacctgcctcagtagaatatgatctggtttacactgagtaatagatactttatttaacaggagttactccaaactttcatgcaagtattcattagacctctcccactctctggacaccacataggatctaaaggaatatgagttggggtccagcataaagacaattacagacaataggataagacaaatggcactctgttaataaagcatgtattctgtttgtttggttggttggttttttgagccacagtttcactctcgtaactcaggctgcaatgcagtggcatgatctcaggtcactgcaacctctgcctcctgggctcaagtgatccacccaccttggcctcctgagtatctggaactacaagcctgcaccaccatgcccagctaatttttgtattttttgtagatacagcatttcaccatgatgctcaggccagtctcaaactcctgagctcaagcaattcacgcgcctcagcttcccaaagtattgggattacaggcatgagccaccacacctggtatttttaaccagggaaaatattagtacttaggagatctgatagaggcagaagcagtaaagggcagtttgttgaaataatatgaaaagttttcctgtagaatatgcaaattttgactggttagaaagtcagaaagaaatgcttttgttctgaggatataaaccttctaaattgctcttgaaggttgaaattttttggttgctgttttgttgcttcatgttttaattattattatatttatatctctcttgttaaatctggggtatggggaacagtgccattaccagagaagaatttacaggattaaccttaaatagaagaaagtgtctctcttctaagtattaagaaattatctctgtaatagtgaacttatcggtaatatgattcagggacaatcattctatgaaatataattaaatgcccaatattcttcttttttaaaaaaagtttctattagatttttaaagtacagctataattcatgttgtttgtaacaaaagttgcaaagattaaaaagaactaatattttaccacttgtcctcctttctcagtctctgaagtataatcaaaatgatatgatatatagtgttctcattttatccaggtgttttatgcatctgtagtatcatctctttgtttgtagaacaacagatgactctccctcatttatttttaaaggctacataatactccatagaataactgtaccatggtatttcagacagccttttgagggacactcaggttgctttcagttttttttttttttttttttttgtcgttgttgcgccaatgctcttaacagtagaaaaatacctttcaatatatatctatatttagtggctgttttatacctgtaagatacgtttataaaagtatgtaaaatatgtttatattagtatgcatattatgtttagtatagtatgtatagtatgtatgtatagtatgtatgtatagtatgctatgtttatattagcatgtatgtatattaatatgcttataaaagtatgtaagatgtgtttataaaaattgaactctggattcaattttaatttgtatagagactgctagtttattaatttatcaaaatccacatcaccatatacttagtcacactagatgctatccccatttttgttcttctgaagggtgatacaaggcagctcattattgttttatttcctatatccttgattgtaaacagaattgaaactcatatccttattgctcaaatattttccttctctgtaatttacttttccatttttctgatgaatcatttgcttttcttagtattttcaggagcttgtcatatattatgggcattaatgtcgggtcatttacaataaaaacatttttcttgtcaattttttgttcttttactctgtttatagtatagtattgcctatatttttagttatattttatgtaaaccagtcctggcttgtttaagaaaaatctcaccacaaaaatgttgcacaaatagtatctactagtttttaaaaataatatatatatgctatggtttgaatgtattcctcgaaaattcatgttgaaatctaatccccatggtgttggtatgaataggtgagatgtttgcagaagtgattagtcgtgaggtctctgccctcgaggatgggattagtgcccttatcaaagtgactgaaggagtccctttggctcattctgccagaacacagcattccccttttcattatgtgaggatacagtacttcctgcttcctccatatgaggaatacagtgagaaagtgccatctctgaagcagggagagagccctcatttgacaccagagctgctgggtctttgaacttgtacttctcagcctccaggactatgagaaataaataaataaattatccactctaaagtaatttgttatagcagcaggagcaggttcaggctaaggcattatgtgtgtatgtatttataaaatgttgcacaaatagtaactactagcttttaaaactaaatatatatttatatgctatgtatatatgtacactgacagctacttatcatattcaataagttttaaatagattacaaatctaaatgtacagttatatacattaattttgaccttacatgtaatgaacatgcattatatttagatatttatgtatataatttaactacatagttataattaactgtaatttaactacgtagttaacaatacttgttatagtttatagttcaattatagttaactatatagtaaaattatgtgcacatatatctaaatatgaataaatgcatatatatctaacgcatatatatgtatatataaagctaaatatagttaactatatagttaattataactagttataatatataatatataaatatatataactctatatttatagttaactgcatagttagccatatcattaaaatatatgcatatgtatatttaaatataaggaatgttcattatacataagattaaagtcaacatatataattgcacatttagattattaatttctttaaaaattattattgaacattgtaagtagctgtcagttttttgttttccatgtaaatatccaattaagccagccataactattaactaataacttcattagttaaatgggtactgaattcaatcaaatcattttgtggaattcactatacaattatatttttcttcttttattgtgtttttatcaattatactgttagtttttctaatgtatgaacacccttacacttttaaaataaagtattcttgatcacaaatgatattcttattgcactgtaaaatttgatatacttttactttatttagaatggtagcattcttaatcataagtaaaattagtttgtagtttacattcttatgcatctttttcagattattaaaattacagttctttataaattaaattaagctgagtatcatccatttttatagtctttcactttaaaaacaatggaataaactatctcattattatagcaaaaaaaattaaaccataaaagtatcaggcccttgtatttatttgtaatggtaaatattcttcaatatgtttttccacacttcaataaaagtttttcttttccttctttatggtttctaaatgtccttgagttaacaatggacttggattattatttcataatctttctaatccacaatgaacttattttggtttttctttgttttccataatggttgatatggtttggctgtgtccccacccaaatctcatcttgaattgtaactcacacaattcccacgtgtcatggggggaaccccgtgggaggtgattgaattatgggggtggatatttcctggtctgttctcgtgatagtgaatgagtctcatgagatctgatggttttaaaaacaagagtttttctgcacaagctctctttgcctggcaccatccatgtaagatgtgacttgctcctccttgccttccaccatgattgtgaggccttgccaggcatgtggaactgtaagtcccttaagcctctacttttggaaattgcccgtctcgggtatgtctttatcagcagtgtgaaagcagactaatacaatggtgtttgccaaaatatatctattatggtcttttaaaaaaatagcttaatttttttctatttttttatttttaatttttatagatatataatagtcatacatatttatgggctacatgtaatattttgataccagcatacgatgtgtaatgatcaaatcagggtaactaagatatccattatctcaagcatttatcatttccttgtgttggggtcattctaaatatcttctattttgaaatatataatagattattattaactatagttaccctataatgctattgaacactacttattcctcaggtaaaactacttatcattccatttatttttattagctgattttctagttcattataatcacatatttttgttttaaacctgatttcttaaggtaaaaacttatcttttaatacttttactgaggaataatgttatgctatacagtgtagcattgtaagtgtacaatacaattatttttaataagggatgggactgtatttcttgagttgtttcccttcagtggcttcaatccattattaggtccttgtctaatttatatatttgcatttctcttacgaagtataaactgtatttaataaacttttaaaatgcaattataaaattgattcatcacttgagcaaatatgttttattccttcataagatgtcaataattggttcaagagttggtaatataatatgtattcaatctagtggcagaaatagacaagaaaagacttaattgtaattcagaatgtcatgtctaaattgatatttagataaagtactatggggacaacttatgaaggactggttacttctagcttgaaggaagtgtgataggagggctgagataagataaagttttcacgaagaagctcacatctgacatagctttcagagactttcttaaaagagaaaaaggaaaatgttttaactaaaaaatgataatagtatgtgcaaatattaggagttataatgacacatggaatatccatagaattttgaggatatttacttctgatgctcttcagtttgttttcttatgtttggtaacatgaaatttaaaaagaccaaattcaaaagtttcataacaaatgagtcacacgtgactcatttagcaagaaaggatttcttcacttacaaatctttggatttctagaatgtactaaagatagaagtatctcctgtaaatatctgataaaaagagatatacttgcctctgttcttcagccactgaagggaaacaagaacgacaagctcatccctaaggatgatatcatgcaccttcctaataactttaaatgtcttgacatattaaagtttgagttaagctacaccagagttaaaagcaccaaccaattcctcagtcactttctatacatgcttcaattctttttaaaattaggttgaataataagttatagcttaatcattgatttaactagaaatgataatcatctggatcatattaatattggaacacatagattgaatgctatagaaataaaatttatgtggctacatttctgccagggaacttaaggagtcctataaatcatcatttcagataatccaaataaccaagaatgtggaaatcatattgtatctatgcttattcttgtttatataaccatgacaaattatttttacataattgacacagaatcatttcattcctgctgtaaaaagaaggaaaaataagtaccattcaaaaacattctactaaacttgacagaaatattaagacagcagaagatgttttcaagatattgaattatgaataagcagaatgctagaataaccatgaaagttaaatatacatccaattttacaagcacttggaaaaataccagaaaataaagatacaggcactgataatacagatattaattgtaaatgatatactatgatggaagttgataactaatacaactcattagctaaattatatttccaaaacaggaagcacagatatacataatgggacaaaaagtaaaataatgaaaactaagaatgttctaacaacacaaagtataaaaattctcatgtatactttcacaatataaagaaaactaacaacatgtattctgaattcactgtatcagaatgtcttatagacattaatcaaagtctaataataactaaaaatgattttaagatgagaaagagtgtataagtttttaaactaagattcttggtaattttcaaaatgctgtgcaaactatgcctatgaccctcaagagcatttttgaaataaaaaagaaagtatgactttttcctattatcacctcttctggcaatgctgtacactaccatgagctttgactacattttccagccttctaaagtgccctactgaaactttgttatcctttctctttattgaaagtagtccaattcactgagctccaggaatgtgtaaataattttcagtaagtcatcgttcagtttgagttttaagccattattttcttgaatattttttgtgcctcattctcactctcacctgggactctaattaaatatatgttaaaagttttaatattatctcatagacaacttgggctctgttgatatctttaactttttttctcttttcttcatattgatctatcttaaagtttagtaattatttcctttgtcatcttcattcttctataaagcccataaaatgtttctttttcaaatatgcgtgtttcagtatgtttcagttttataatttgcattcagttcttttaaaatattttcaatttctttactgagatttcctatttatttattaagtttattttattaagcatagatttattggctgatttatagtctttatctgaaatttcaacatctgggtcgtctcagggttggactctgttaatcatatattttttctttgaatgtgaagccagtctgtattgtatccaagtcattatttctgcattctctaatattcctccaaagaaagatactatttttatattagaaggcaattaattggttaggctcaaattacatactttgtgtgcctatggagggagacagccaaaatctcagtgttgttcttttagccttagctgcaggatgttttgagtctgctgcagacatgctcaattcacctgtcagcctgagaattgggcaaagtttgtataccaatttgggggctcttatcttctggatttctcttttctgagatgcctctccaccttactttctagtacctgcagttatcccaggctcattcctggatgccaagaggatagattctctaccacagtgttagttatttgcagtccactgcacctgcagactgtccttacactaagactaaaaaatgaaaacgtatcctatgctggtcctgtcttccaagttttgtatcatctccaaatctgcctctgatacttaataatttgtttacacacacacacacacacacacacacacacatacctatataatataaattatacataataagtttttttgtttatagttgtgatctgttggcgggctggaccatttgaaacttactccttactctatcataccagaaatggaacttttagtaattaatctgaagggctgcaatctctatcatcactcataaggtcaagattaaacccatacctttaaacacagctcaaaatattcagcaaataaataaggcagtcactactgatggtagtaattattgtccaagacttgtattttttggagatatttcttatccccaaacatatccagcttcaattggtttatttctggtacttaatccttggttctactcttttatttataatccagcaaatcctctttggacttatattttaaattactcctgactctcaggtctccttatcaaggatattagtctactgtagacttaaacaatcagctcttttaacattgagcaactagagtaaaatatacctactacccaccctctcccatactacgacaggtcttttggaatcttacttatatagcacattcacaaaagacagcctacaaatatatcttctgctgcaaaggatgtttgttttagtgggtcttaaaaatatcttgatattcattttcaagggtggatttttacattagctgtggctcttacttgcaagctactgttaatggcaacattttcccatttgccgaaaactactcacaatgacagtggcttccaccaacaattttcgtcaaaggcaagtgatagtatatttcgtttttagaaactccctgtagtagtttctggcaatcatctttttctctctctactttttgaaaaagttcatatatatatatatatatatatttcccttgaacaatttatatgaagctcaatattaggaaaatgtcctattaattttttaacactcactagaaagcaatataacaagatgacctgtttaagcccctagtacagctgtggtaaccaaacagttcttttagaggaatatgtgcacattctctagagttgtttgacaaagagttgacaaacattttctataaacagccagacagtaaatattttgggctttgtgaggcatacaatattttccacaacaactcaactttaccattgtagcacaaaattagccattaaaactttatttacaaaaataggtggcaggcaatttggcctgcgggctgtagtttttcaatctttgctcaagagtatagtgtgaaacaattccaatttgccattgaacttctccagcattcttttatgtgtcccaaagcagacagaagtacagagactcataacttagagagaactcttgcatcttaaaggcaacttaactcttgtatcttaacagtaacttcctaggtattgatatgagaactcattatttcagtgattccataagccaagtgactaagacacttggcgagagatacaaattatggaatttctgctgtcctactcaactggaaaatcagtatctgtgttatacttgtgccaccaaattaaataaactaaacttcatgtcacattttgatttcaaaagtggcaccattctataaaagttatatcttaatcaggaaataataaaagaaatacctgtggctaaaaatggcaaactgatcaatggaaaaaagtccagaaacaaacccacacacgttcctgatctacagcaacaacaataatatgaagctttggtgctgtggggagcggaggaccatcttaatacattgcactaggtcaagtggatatatgtatgagaaaaacatcatctagattctcatctcacaccatacacaaaagttaatgtcataaaaatgtgttatataaaagtaaaatataaaacaataaagcttttagaagcaaacattagagaacaattccatattcttagggcaaataaaaagttgatacattgaactatataaaagccaagaacttctgttttttaaaagacattgttaatagagtcaatgaatccacagtgtgaggagcgtttcccagaataaagaaagaactcaaaaaaaatcagtaaggaaaaggaaacacaacagaaaaaatgaacaaaagattgaaaagacactttatcaaagaatatatccaaatggccaaaatagtatattttaagaagacttcaagttaattagttatcaaattaaagtcatgctataccattacacatccaccagaatagattacgtatgctgaaactctgaaaggtagacagaagttagactggtcaggcatcttgggacccaaggaacagcatgatggtgaattacctgggtttttattctccctcatatatcccagacttggagctgaagaagctgaccacaggcctaaagaagcttgcaaccgactaaagaaaggaaacaggagggatccttgtgatgatagaaatgttctatatcttgactctatcaatgtaaatgtcctgtgattttgttgtgatgttggaccacactttacaaataccgccatcaggaaaaaactagtaaaggatttgtgaagcttctattacttcttaaattcacaggtgaatatacagttaaaattagaaagttaatttaaaatatttattcaatgctttctgtgtgccaagtacaattatagatgctaggaaataagcagtgagcaatgccaacaccatctcttcaagatgtttgcaatctagttagggaaacagacaataaacaaacaataaaaatgtcaagtggtgaaaatgaaggaaaaaaaaacagtagtgaacatatagaaagatagaggagatgatatttcacatatggcattgggagtggtcttggcatggtcaaagaatagtaactaggcctttgtatccaaagtgtggttaatgaggtggagactggtaggattttgagttccaacatagtgggaagccagatcatatagtgccttcactcataataaggctcaattttaatctaagtgtgtgaaaggtgctgagggagagggatcatgtataattttgaatagggcattgccttgttctgacgtgtttaaataaggtgactatggctgtcttgttgagaacagactgatgaggaggacgtaacctattgattttcagttttgtatttcatttgcatttgggttttggttttgttttgttttgctttccttatttccttttttaaaatttttccataagttattggggtacaagtggtattggttacatcagtaagttctttagtggtgatttgtgagactttggtgcacccatcacccaagtagtatacgctgcaccttatttgtagtgttttatccctcgtccccctcccactactcctcgcaagtccccaaagtccattgtatcattcttatgcctttgcatcctcatagcttagttctcatatatcagtgagaacatttgatgtttggttttccattcctgagttacttcacttagaataatagtctccaattccatccaggtcactgaaaatgctgttaattcattcctttttatggctgagtagtattctatcatagataggtaggtaggtaggtaggtagatagatagatagatgatagatagatagatagatagacagatgatagatagatagatatgtagatagatagatagatagatagatagatagatagatagatagatagataatcacactttctttatccattcattgagtgatgggcatttgtgttggttccacaattttgaagttgtgaattgtgttgctataaacatgcatgtgcaagtatctttttcgaataatgatttcttttcctctgggtagatacccagtagtgagattactagatcaaatggaagttctacttttaattctttaaggaatcgccacactgttttccatagtggctgcatgagtttacattcccgcctgcagtgtagaagtgttccctgattatctcatccatgccaacatctactgttttttttattatggccattcttgcaggagtaaggtggtatcgcattgtggttttgatttgcattttcctgatcattagtgatgttgagcattttttcatatgtttgttggccatttgtatatcttcttttgagaattgtctattcatgcccttagcccactttttggtgggattgtttgctttttcttactgatttgtttgagttcattctagattctgtatattagtcctttgtcagatgtacagattgtgaagattttctcccactctgtgggttgtctgtttactctactgattgttcctttggccgtgcaaaagctctttagtttaattaggtcctagctatttatctttgtttttactgaatttgcttttgggctcttggtcatgaaatctttgcccaagccaatgtctagaagggtttttccgatgttatcttctataatttttatagtttcaggtcttaggtgtgcatcttgagttgatttttttataaggtaagagatgaggatccagtttcattctcctacatgtggctagccaattatcctagtaccatttgttgaaaagggtgtcctttccccactttatgtttttgtttgttttgtcaaagatcagttggctgtatttgggtttatttctgggttctctattctgttccattggcctatgtgcctatttttgtactagtaccatgctgttttggtgactatggccttataggatagtttgaagtcaggtaatgtgaagcctccagatttgttctttttgcttagtcttgctttggctatgcaggctcttttttggttccatatgaattttagaattgttttttctaattctgtgaagaatgatggtggtaatttaatggaaattgcattgaatttgtagattgttttggcagtatggtcattttcacaatattgattctacccattcatgagcataggacatgtttccatttctttgtgttgtctatgatttctttcagcagtgttttgtagttttccttgtagaggccttttgactccttggttaggtatattcctaaatattttatttttatttttatttttttgcagctactgtaaaaggggttgagttcttgatttgatgctctgcttggtcgctgttgttgtatagaagagctactgatttgtgtacattaatcttgtatctggaaactttgctgaattcttgtatcagttctaggagatttctggaggagtctttagggttttcaaggtaaatgatcatgtcatcagcaaacagtgacagtttgacttcctctttaccaatttggatgccatttatttctttctcttgtctgattgcttggctaggacttccagtactatgttgcagagtagtggtgagagtgggcacgcttgtgttgttccaggtctcagagggaattctttcaacttttccccattcagtataatgttggctgtgagtttgtcatagatggcttttattacattaaggtatgacccttgtatgccaattttgctttgagttttaatcataaagcgatgctagattttgtcaggtgctttttctgcatctattgagataatcatgtgatttttatttttgattctgtttatgtggtatatcacatttattgacttgcatatgttaccatccctgcatccctggtatgaaacccacttgatcatggtagattatctttttgatatgttgttgggttcggttagctagtattttgttaaggattttagcatctatgttcatcaaagatattggtctttagttttttgttttctgtttttttttttttttttggttatgttctttcctggttttggtattagcatgatgctggcttcatagaatgaattagggaggattccttctttctctgtcttgtgaattagtgtcaaagggattggtaccaattcttcttagaatgtctggtagaattctgctgtgaatctgtctagtcctgtattttatttttgttggtaatttttcaattactatttcaatctcactgcttgttgttggtctgctcagggtatctaatttgtcctgatttaacctaggagagctgtatttttccatgaatatattcatctcttctaagttttctagtttatttacataaagatgttcatagcagccttgaatgatcttttgtatttcagtggtgtcagttgtagtgtctcctctttcatttctcagtgaggttatttggattttctgtcttcttttcttggttaatcttgctgatggtttatcagttttatttatcttttcaaaggacccgttttttgttttatttatctcttgtattttttgtttgtttcaatttcatttagttctgcttggaacttcgttatttcctttcttctgctgggtttgggtttgatttgttcttgtttctctagttccttgaggtgtgactttagaatatcagtttgtgctctttcagtctttttgatgtaggcgtttagggctatgaactttccttttagcaccgcctctgctaaaaattccagaggttttgttaggttgtgtcattattgtcattcagttcgaataatttcttaatttccattttgattttgtttttgacccaatgctgattcaggagcaggttatttaatttccatatatttgcatggctttgaaggttccttttggagttgatttccagttttattccactgtggcttgagagagtgcttgatataatgtcaattttcttaaatttattgaggctcattttatggcctattatatggtctatcttggagaaagtttcatgcgctgttgaataaaatgtgtattctgtggttgtgagatgaaatgttctatatatatctgttaagtcatttgttccaaggtatagttttaattcattgtttctttgttgattttctgtcttgatgacctgtctagtgctgtcagtggagtactaaagtcccccactattactgtgttctgtctatctcatttcttaggtctatgagtaattgttttataaatttgggagctccaatgttaggtgcatatatgtttaggattgtgatatttttctgttggacaaggccttttaccattatataatgtccctctttgtctcttttaactgctgttgttttaaagtttgttttgtgtgatataagaatagttaccctggcttgcttttgatgtccatttgcatgaaatgccttttcccacaccttttctttaggtttatgtgagtccttatgtgtaaggtgagtctcctgaaggccccagatggctggtgagtcctcatgcattctgcagttctgtattttttaagtggagcatttaggccatttacattcaaatgttagtattgaaatgtgaggtacctttgcattcatcatgctttttgttacttgtgtactttggatttttggttttgcttttgttatttacttgtgtttttgttttataggtcctgtgtgatttatggtttaaagaggttctgttttgatatgtttccagcatttgtttcaagacttagagctccttttagccattcttatagtggtggctaggtaatggcaaattctctcagcatttgtttttctgaaaatgactgtatctttccttcatgtatgatgcttagtttcgctggatacaaaattcttggctgataattgttttgttcaagaaggctgaagatagggccccaatcctttctagcttgtagggtttctgctgaaaaatctgctgctaatctgataggttttcctttataggttatctggtgcttctgtctcacagctcttaagagtctttctttcatcttaactttgtatagcctgatgacaatgtgcctaggcaatgatctttttacgatgaatttctcaggtgttctttgtgcttcttgtatttggatgtctaggtctctagcaacacaggggaagttttcctcaattattcccccaaatatgttttccgaatttttggaattctcttcttcctcaggaacactgattattcttaggtttggtcgtttaacataatcccagacttcttggaggctgtgttcatatttttttattctattttctttgtctttgatggattgggttaattcaaagaccttgtctttcagctctgaatttctttattctacttgttcaattctattgatgagactttacagagcattctgcatttccgaaagtgtgtctaaagtttcctgaattttttattttttttttctttaagctatctattttcttgaatatttctcccttcacttcttgtatcttgttttggatatccttgcattgggctttgcctttctctggtgcctccctgattcatttaataactaacctcctgaattctttttcaagtaaatcaaggatttcttcttggtttggatccatggctggtgaactattgtgattttttgaggggatgttgaagagccttgttttgtcatattaccagggttgcttttctgggtctttttcgtctgggtaggctctgtcagggggagggtctagggctgaaggctattgaccagattcttttgtcccaaggaatgttcctttgatgtagttattctcccccttttcctatggttgtggcttcctgtgagccaaactgcactgactgttgtctcccttctgggtctagccacccagcgagtctacccggctacaggctggtactgcaggttgtctgtacagagtcctgtgatgtgaactgcctatggttctctcagccgtggataccagcacctcttccagtggaggtgctgggtcggggggtgctatggactccatgagggttcttagctttggtcatttaatgctttatttttgtgctggttggcctcctgctgggaggtggccatttccagagagcatcaggtatagtagtatggagagggactgacagtggtggggctctagaactcccaaggttatatgccctttgtcttccactactagggtgagtagggaaggaccatcaggtgggggcagggctaggcatgtctgagctcatactctccttgggcgggtcttgctgcagctgctgtggggggtgggggtaagattcccaggtcactggagttgtgtacctaggaggattacggctgcctctgttgagtcatgcaggttgtcagggaagtgagggaaagctggcagtcacagacctcacccagctcccacataaactgaagggctggtctcactcccatggtacccctgcaacagccccaagtctgtttccaggtgaagggcgagatgggcttgaaaacttgccccaggctacctgcctttcagctatgaaagaaaagggcttggttattccccctcctgtggagtctgcacacaggatttgcaccctctccccatttctggccaggaggcttctcaccctgttcaaatttttacaaagttccgttagtgatttcctcctccctgtggagttttaccccctgctcctctggccaccctcccaatggatctctgtggtgccaggaaggaataggctgctaggggacccagtgagctcccagggcctttctgctgctttctctacccctgtatttctcttggttctctaaattgactcatctccaggtaaagtcagaaatttctcctgcaaacagaccttcaggttctccagtgggggtgcgtgtttgagagaggagggtctccctttcccacttcttcagttaggacactcacagtatttgcagtgtctcccacgttttgcaggagcagtctgcttccttcagagggtctctgggtcctcttgggattgctggtttgttcttgcagttgatttcacttcttacttctgggtttcagttatattattatatataagctatatgcacaaggagattatattttttggcagtgatgcttaaaaacttggattccagacccagactgacaatcactagctgcatgaccatgttcaagttatttagcctctttcatcttcaatgttttcatatgatctatggtgcaataatagcactcaagtcagaaggcttttattgggattaaatgtgttatatgtgtaaagatcttcaaatagcttgagacatggtaagtaccatggaagtgtttgctatgtcatttttgtgttggtacatatttgagtaacattgtaatgaaaacaattaaaagcaacatgggagaaagcataaaaattattttccttaagagggttcatactctagtgactttgaaaaactgtttgagagcgtgctaatgtcatatagctcagatgcttactatttacacatcagtaattattgtaggggcagggaaggcactataaaatttgtctgtaaccaaaaattaaatatttttttctaacttgcaggccaatcacattttattttaattttaaaattaaaaacccaaatatgatgtatatagtaaataccatcaagatacctattaatgagaactattattttctaatttcttgagtggaagttattgtagtagatatattctgctttttgtcctgcatttgtacatttgggcaacttctcttctctctgtattgcactattgggaatataggtcatagattgccaaagtgtcctgttctcctggccacaatcattgattcaggaataggaaggtatccaagaacagctaaccagtttccacatggaattggacatatggacactgttttttttttttttagatgtttccctcttcccctcagacacatagcaataagagccaaattaacaacacagagtctgtctgagaattaagttaaataatcccaacgtgaactagaaaaagaaagaaaatctctgtaaatgttatttaattatagaacaattgacacaatacataaaaatatggttgtgttctatgtgaaatttgtctttattctagaatagtgattttaaacatgagagattcttacctaataatatcaattgatcaaatttgtgatactaaaacataaatcagtattcatccttccaacactggttctatttacatgaaattgtatcattttagaggggaacaaatgtgatttgccgttttttaaatgaatcttctgtaggtcacattatatttgggagtagtttctaattattattcaaaaaaagaaagaaaggaaaaagggaaaatttctgttcctatctgacacttggcatattagtcaagatcaaatacagaatacaataccctaaatgaaaataatatgtgctatatacaccatggagtactatgaatccataaaaaagaataacgtcgtgtactttgcagcaacatggatgcaactggaggctgctatcctaagtgaattaaggcaggaacagaaaaccaaatatcacatgttgtcacttaaaagtgagagctaaataataggtttcatacagctaaagaatggggaccctatagctcatatgccatatataaagatggcaacagtagacactggggaccactagagtgaagggggtggaggaagagaggggaacaaggaatgaaaaactaattattgggcaccatactcactacctgggtgaagggatcaatcatacatcaattttactctaagtaaaattgcattatgcaatatacccaggtaacaaacctgcatatgtaccctctgaatccaaaataaaagctgaaattataaaaaacaaaagaaaatagtatgtgctaaatatttatatggtgttggttagtcatcatttctaaaaacccaatgagtcctaatgccagtcttctcaaaagctcatatataggatagaggaaaaatggtgaaatatatagtatttatttacaaagagaaggcactatagatgttcatttacttcactgtagtgaagtattattaccatcttattatatatgtgcatgtgtcatcattttgtataccttcaatatacacaatacaatttatttatttattttattattattattattttgagatggagtcttgctctgtctcccaggctggagcgcagtggtgcaatcttggctcactgcaacctttgcctcccaggttcaagcaattctctgcctcagcctcccaagtagctgggattacaggcacctgccaccacacctggctaatttttgtattttcagtagagatggggtttcaccatcttagccaccttggtcttgaactcctgaccttgtgatccatcctcttcggcctcccaaagtgctgggattacaggtgtgagccaccgcacccagccataaaatttattttcaaaaatgctttcacagaaattatctcatttgaacctcaaacaaaaccttcaagaaggtaactgcattattttttaagaaaaaagtttcacagaggccaagtgtgatagctcacacctataatcccagcactttgggaggctgaggtggccggatcacctgagatcaggagtccaagagatcaggagttcaagaccagcctggccaacatggtgaaacctgtctctactaatggtgaaaccggtgtctactaaaaatacaaaaacttagcaaggcatagtgatgggcacctataatcccagctacctgggaggctgaagcatgagaattgcttgaacccaggaggcagagtttgaaccgagctgagatcgcaccactgcactgcactccatcctgggggacagagtgacagtctgtctcaaaaaaaaaaaaaaaaaaaagaagaagtttcagaaagattaagtagcttatctatggttaaaaacaaaaagcaaaaaactggtaactcacagaggtagaatctagtctcagttcagctgtttccaaatctctatgtggtacataacatattttcgaagtttgcatctcatgtgacaatgtgggaggcataatcaaaacatggaaacatgaaacaactagagaagtaatcacataattaactattataacagcaaaaaaaattaaaataggattaaattgaaggggtgaatgaaggttagtgtgatcagttagtatgatggcagaaaaagaaaaatattcaatgtgtcctaaaggatacataaaacaggaacaggtgtcgatagagttcatgtaacagtaagggacatttcaggaagcttgagtttggtgggaggagtggagctttggagatacaatgggaggttggagaggtgtgaagaaaaaggtgatgtcactttataaaggaaactggaaagtaaggcagagcaatttagacttgaaggaatttcatttgcttctaaaaactgaagtattgtaacatgcaatatgcctttcacaaacaaaatagtcacatatgcctctcagaaagaaaaggtaccatgaaataagagaaagggacataggacactgtgctgtatgtaaaaaagaggagagattaagtgtgataaaatgttctacttttaaagcaggtaattccacctttctgccaacaattattattttaaaaggaggcaaatagaaaaaaaattatatgttagattactaaagaatatacttcaaatctataagaattgaagcagttagaaaaactaaatagtttacaaatgtgacagcaaacgttaagtttcctgtgagatttacaatgtctttgtatctgccctagagatcactggggcttaatagaccaccaagtacaaatgaatcgttttaaaagattttaacgtcttttgaagttcctacttagaagtaggatctttaattgactaataattgtgttaaatcaaaatcatggaaaataagaatgtttataatattattttactttaatttttggcaaggtagaaagttatttaaagagacatcaaaaacaagttgatctactttattactttgttaatctatgtcctctgagaagcagacatctcatgggattaaaatcaggaggaagctggaaaaggctaagagaacagtcagatcatgatgaaattattaacctgagtgaaggagagaagaaaggatgattgggtacaaacttcctagactgctgtgcagtttgaggaaaatgaagtgaagttactgaggagtcccaaggcacaggtagccaccagaggcatcaagtgtgtccagaaattggcctgccttaatatcccagatacacctagtcatcggctaagcacagcccatgggaaatgtagacatagcctcagcatagatgcaatcatgggtttcagagcatgacagctggagctcttggccaattgccctccttgtggttggagatctaagaggtgcattcctatgggtgccagagtcactttgcttaaggctggacatgatctcatgcaacattaaaaagagcttttggcattttatttttgatgaacaatatataactgtgagctgtctattctactggaatttaatacttctattactttgtagttcttatattgtgtcacaaatggaaactccccataccatattgtgaagtgacatcctgaaagataatgagagccacagctataggcaggcaatgccaccgtttctagtaggccactgaattatccgtccactcatctagttaaggtatccatttattatttttttttaaaaaaatacacatagtctggcctttgcctaacttttcaacctcatcttttatatttcacctatggcttactgtacactatcgttcagtggtttttttctgttcattgagcaagccaaactcattataacctcagaatagtaatagctatactctcctttgcccggaatgttcttttagattttcacatgttggactctcacactattcagacctcagtgcaagtattactacctcaatgaagctttggttgatcagctcatctaaactagcaccttgtcatccaacaacagctatccaattactggtgcttttttatattatagtacttactagtaactgcaataatatcattttgttattctccagtctttgtagatttgtgtccctggaaaatcatagaactaatgctctctaccatataatcaatatctagactagcaattggcagctaaaagtcaataaatatttgttgaataataattgacaaaagaagacttctatatttcagttgctataatgggtctgagaattcaaagatatgatttcttccctcactagagattatagtccaaatagaaagtacagtctaattgcttagaaattacttttccctcacctcctaacagtcatctattctttcttaagttgctccaggcattccttctcatgtaccaattaattgtctatttttgttgttgttgttgttacataaataagttctttagtggtgatttgtgagattttggtgcacccatcacctgaacagtacaaattgaagccaatctgtagtcttttatccctcactcccttccttccctttacccccaagtccccaaagtctattgtatcattcttatgcctttgcatcctcagagcttaggtcccacttttgagtaagaacatacaattcttgcttttccattcctgaattacttcacttagaataatagtctccagtcccatccaggttgctctgaatgccattaattcattcctttttatggctgagtagtattccattgtatataatagtttctttatccactcgttggttgatgggcatttgggctggttccacatttttgcaattatgaatattgtaatgctataaacatgcgtgtgcaagtatctttttcatgtaatggcttcttttcctctgggtagatacctacagtgggattgctgggatcaaattgtagttctacttttagttctttaaggaacctccacactgttttccatagtggttgtactgtttaccttcccaccagcagtgtagaagtgttcccttttcactgcatccatgccaaaatctattatttgtttattttttgataatggccattcttgcaggagtaagatggtattgcattatggttttgatttgcatttccctgatcattagtgatgctgtgcattttttatatgtttgttggccatttgtatatcttcttttaagaattttctattcatgtccttagcccactttttgatgggattgtttggttttttcttgctaatttgtttgagttccatagattttggatattagtcctttgtcagatgtatagatggtgaagattttctcccactctgtgggttgtttatttactctgctgactatttctttttctgtgcaaaagccccttagtttagttaaatcccacttatttatcttcgtttttgttgcatttgtatttgggttcttggtcatgaaatctttgcccaagccaatgtctagaagggtttttctgatgttatcttctacaatttttatagtttcagtcttagatttaagtccttgatccatcctgagttgatttttgtataaggtgagagatgagaatccagttgcattctcctcctcattgtctttttttttttttttttttttttttagatggtagaatagctctgaacaacagagactttggaacaacagaaatatggcattcaagaaggcaatttctctagaactttatttccacaaattcataaataataaaacactagattgcatgcttctgaaaaatttgaagttttacatatcaagatcttttagaattttcttgaataaaacattactacatttggtcaacaaatgtctgctgataccaaccatgcaccaagcaatgttttgaaaaaatggagatacaatgcagatccaaacagataaaatccttacagacttagtgtttacttggaaagagagatatacacaataggcaaagaaatgaatatcacaaactgagatagggctttgaagaaaaaaggcaccaagtagggaaaactgcatataaaaggcttagtctagttatatagatcagagaagatgcttcagagaaagcaatgtttacccaaaaaaaaaaaaaaaagttactgggtaaaagtgaagggtatgtagttaggaacatatgaaggcaagagccttctagcagatgaaacagcaagtgtgaaaaaactgaaagaaatatctaacaaggggctgggcacagtggctcttgcctgtaatcccagcactttgggaggccgaggtgggtggatcacttgaagtcaggagtttgagaccaccccagccaacatggtgaaacctagtctctactaaaaatacaaaaattagcaggtgtggtggcaggcacctataatcccagctacttgggaggacaaggcacgagaatcacttgaacctgagaggcagagattgcagtgagccgagatggagccactgcactccaacctgggcgacagaggaagactctatctccaaaaaaaagaaatatctcacaatgacctgaaagaaaataaggaaccataatatgtgtaagtccttgtaaagtttgtaaattaggctaatcttaattttaaaaagcaaacaaaaaactaactatgctagcctttatttaaaaaaaaaaatcctaactttgggctgggcacagtggctcacacctgtaatcccagcactttgggaggctgaggtgggtggatcaccagagatggtgaaacaccatctctactaaaaaataaaaaaatagccaggcatggtggtgggcacccgtaaccccagctacttgggaggctgaggcaggagaattgcttgaatctgggaggcggaagttgcagtgagcagagatcgcgccactgcactccagcctgggtgatagagcaagactccatctcaaaaaaaaaaaaaatttaatataaaaaatgacataaattaaatgtgcacaatctatggaccttaagcatgtgttcgttatgatgtcctgcttggcaaagcttctagaaaaactgttgtttggttaggctcatccaggtttggactagccaagtatggaagaaatcgagcagtactggttctaatgatggaattagctgaaacttggagccatgattttgcaggtggtgtgatgaagaatggcagaccctggatttattgaaaatttaattacatacttagtacaattaaaccatgaaatcatgagggaacaaaaaaaattaaaaaaaatcatcaatgctgctgggcagctggaaacattttcatattacagacttaacttctattatcagtgtcaatatctatatcatcctctaatatctcatatgaatttcgctaatggaattaggaacaaaatcaggtggcaaagagcaagtatgctcacttattgataaaatacactggcgttgtttgatctcttcttcacagtactttgcttgtcctttgttgccctgaattacatgtatcccttatgagatgaaaagctaatttatatgattgatgttatatgcttcctgaaagtttaagtatatgaccaaatgagagagcagcaagaaactcactattttttaaaccataattgtgaaagatatgattaaaaatatagagtttctatatttgatagaaaacacaaatttatgtaatgatcttttcattagtttagcaaagcctttgttttcctgcagtaaatgtataattacaaaacttaatttagtatttggctcaattaactctctgcctgtaagttatagaacttttgtaacctgaataattgaatatgttttacattatcctatgtaattgtttgtttttaattttagacttaacattcttgtttattttatctatattattttatgtatgtgtgtatatatatttatttttcttgtttatttcagacattttgttatgattttttgattttgatgaccattatttgcgagaaaatttccaggtaatttttcattcattgcatctatgataaattgatggtatttctttaggaaagaaatacctgttttatcaagcaatcaccttcagaagaattcatatacagtgaagaagaaaatggtccttaacccattagttgaatgaaccctggagcctgtgttgcagctagcttgtcctcacattcatatctaaaccctgagctacaaaaaatttcatcattttaattagatgacttgttcaaaacaaacacatctacgagcaaacaacaacaataaaaacaacttggcatctaatttgaacaaggcattataatagctgtcttgggtgatgccgagatagatacaacaaatttacagccctcaaataatgcacaattaagaagacagtaaaagcatacactgacccagtggagcctgagagagggagtttaaaggggaatatacaaaggactatggaaattcagaggtggttgtgagagagttgaggagaagcaaagggaattttatgaaaaagcacatcttttcatgtacatcctaatctattagaagggtttcactaagtgaataagaataatacatttgaacatttaccatgataagtgagttgtggaaccttaaaaaacatctatgtttgcattcaggcaaaagaaggggtagaaaaagaaaaggtagagtatgagatattttgagaaaacccagcaaacaacacagatataaaagccaattgacaagaaagttcaatggaggaggagatgtctagcaatatcgaatgttctaggtgatcaacaaggatttaaatggaagatttagtatttaatgtggtaacaaagaatattgagtttttcagtttgggaggtagagttaggaggattgcttgaacccaggagtttgagaccagcctgggcaagataatgagactccatctctacattaaaaaaaaattagccaggcatggtggtatgcatttctattttcagccactcagaaagctgagacaggaggatcacttgagcctgggaggtagagggtgcagtgagccatcatcatgtcactgtactccagtatgggcaacagacagagaccctatctcaaaaaaaatcaaaaaagactgttgcagtacattgagagagcaaatgtggtaatgggagggctaaggaacacagagaatttaggtacatattttttattttaatatttaaataaccatatttatattcatagctacaacttatttgtgcattcaacatctattgagcacctactatgttccaggtactcttataagcatacaacaagaagcagaaactgaggtacaaagattttaagtaacttgctcagctggtaagctgaagatgccaagattaggagccaggcagtctcacttcaaaatccgtgtccctagtctcaaaaaaatagcctctttctctgttctaggcactctgatgctttcaatacattacttcatttagtacccactacagtcctgtgacatattgctatgctgatcattgtttaggtaaagaaactgaggcatagcaaagttaagtaactttcccaagctcacacagctagaaaaaggcggattggaattttagtctaaggaagcctgatcccaaggcccaggctcttatttagtataatactatgcaaatattttatttagagacattttggaaaaagtttggaaaatggtaaaatataacaaagaaaataactctacctagcaataactactaccaaatttttaatatatttctttacaatattattgtgcatttttacataactgaaaattttaaatatatacaattatatatgattattatcaagatttaaattatgtgcaaaacactgacgctgcatctagtacatagtaggcattcaaagaaggtatgtacaattatatttctacttttatcattttaattaaattaacatacagttgacccttgaacaacatgggtttgaactatgtgggtccacttatatgtcaactttttttcaaccaaacagggatcgaaaatagagtatttgcaggatgtgaaacctgataggattcgatagggagggctaattttttgaatatacaggttctgcagagccaactgtgggacttgagtgtgcatagattttggtaaacatgggggtcctggaaccaatcccccatgtatactgagggacaaatgtatttatatagtgcttcatacattaaaaggtatattcacatatgctatctcctttgttcttcaatgcatttccaataggagcatgaactttgttacattttcatttaacaaatgaaaaattcaacccgtgaatttaagtgatttgcttaaagttacacacacaagcagtagtaatgcttggcctagaacaccatgtcagataaaatatatgtaaatgataatcaatgtgtcattgcctcagatattgagaaagaaggtacaagatttcattttcaccatgagctaatcatataccaatttcaattccttggggtagaagctacatgatatcttattttgccccaacaatgaccctatgtggcaactgctatgtcggccccacagaatcaacacacacatgcacacacacacacactcacaaccctcagctaaagccatgacaggttaactgacttgctcatatccatgctccttctagatcttgcaaggagtgtatatatctcttttcttctacaactgagggaatagaataagcagagtacaataagaaagatacagactatgaatagaataggtatagaagtagaatgtgcaacttccgttactataaaataccatttcagagaaaatagagtcgagtcaacaccagtggatgcagtgtagggatatgcatttaaaagacagggatatcaccaaacactgaccaggtagagctgggtaaacagtggtgtgggtacctccaaaaagtcagggtgaaggactgcttttgaggcagttaacacaaataacaaaagggtaggagcttgagacatttggtggaaacaccagctattggtgagaggagggtattgtcaatggacaagattttctgcttaactcaccagtcacaatggagactatatggttactgtcagctaatctttctgcagattaatttcccttccaggtgctggcctttagactgatgctaacactcaggattcattaaccatatttatttaaagaaccacaaaaatgccattattcagaaatttcttatgaaagtgcctcataacaaaagaattatcatgggttaaacttatgctgatgctgacccaatgaaaaacatgcttacaaaattatctgcgctgacaactctacaatagtctaacacagggataagctcaagaattctttggagttccattcagcttttataattaggtaatttttctatcacagtcagctggagattaatcataaaatgtgaacagttttattttctgtatttcaggaaacgtaattggtgataatcattataattgtaaagaaatctgcagagccctttcattgtggccatagcaccggctttaaaacaagttcagttgatgtctgtgtgcatgtgtgcacacacatacgtgtgcgcacatgtatttgtgaaagagtataattatacaattaaatgaagaagtaaaaagattcttaagagaatgtgacagttgatggtctgaaagtaaagaaaaggagaaaggataatgcttctgaaaaccatcatttagacacgcaaatggaggcttacataaacctgttctgaccttatgtatttgaaatatttttaaattactgaagtctttggaaactgcaaatagtttcttatgaaaaaagatgctcttacataaaaggaactattaaacttagagaattgaacaatggagagatcagatagtaacttactattctttaaaagtcttaaatatatgtaaaattcacaaaaattcacaaaaagcagaggaatatttgtgtccccctaaaattcatatgttaaaatcctaccccacaagatgacagtattagaagttgagggctttgagagttgattaggtcatgagggattagtgcccttataaaagaggccccagagagctagctaccatgtaaggacacagccaggaagtgtcatctatgaaccagaaagtagaacctcactagacaccaaatatgccttgattttggacttcccagccttcagaactgtgagaaataaatttctgttgtttataagctacacggtttatggcattttgttacagcagcccaaacagactaaggcagaggcttacataaaccctgttctgacctcatgattgtgaaatatttttaaatcactgaagtcttaggaaactgcaaatagtttcttaagggaaaaaaaaaagtgttcttacttaaaaggaactcttgaacttagagaactaagcgaaggagggatcagacggtaacataattctctaaaggcttaaatccgtgtaacactcacaatgcagaataaacatgcacccacgcacaacctaaatctaaccagttactgctgaaaacctgaatgttttggggaagtgtgccagaaagctctaaagatttttaagcttttcctgacctctttattttcactgaaatgcaaatatacatttaaaaatctgtttacataaactgaagaaaaagaaatcaatataaaattttccaaatttcctggattttaaggttagaagcaaaaatgagagaagatattttcataaaaagtaagaaaataatcagttttgattcactaggtccaaaaaatgagtagaaacatacatctaaatgcaccagatttttaaaaattttgttctttatttcaagaacaacactgcatttttggagggatctatttttttcagggaagaaaatatcacaattttgaaaaaaaagagaccaatataatctccctttttgaattctagacgaacgataaaaagcgattttgttaatgattttttaaaaatgagctttgcaacatattggcagccctagactgaagaattttaccgttctaattacaaacagtagcagttattttatactaaacataccaaaacgtaagtgagcattttatatgaatatgaattatttctactgggtacctatatacatgttttaaatattctgtgatttacccagaatctagtcagaagtaggccattttgataaaaagtgcctttagaacatcgatgggtaactaaaaaatctatgcataatgtaaacattccaactatttgttaaataagaaacatttttgattattacttttttaaactatattcaatttggttattggtaaaatttagtttaaggcaggcatatttcttttcataattttgttttcttttttcatgaacatttatcatgtccagaaggcaggcatatttcaatgaagtaatgtttatgcctagctaacattttttatttttaatgatatgatactgggtatattaatgcaaagatcctacaattttattttataaactcttacctgattttgaatccttttttcaacttttccagttatgcatgaagacatcatacttgaaaaactaaatataaattagcttctcttttgtaaaataaaaacaaatttgcaggacttctgctagagagatggattaggtatacattcctctattttttttcttaagtaaaatatacaattaaaaaccttgaaatgaaagtgtatatgtatgtgtatatattacagacacatatatatgtgtatacacatatatagggatatagtttattaagtacaacatacaactacaaaccttgaaagtgtatatatatatatatatatatatatatatatatatatatatatacacacacagatatagaaagagagaggtacatacacagacacacacacacatacacacaccccttaagagttcttaaacttgacagcagaaatatataccataaaaggaaaaattgataaactggatttcatccaaattagattatattactctgtgaagaactctgttaagaggattcaaaaaacaagctacagagttggagcacatatttaaaaaccacaacatcaacaaaggactagtatcaagaatacataaagacctctcaacacttaacattaaaaaaatccagttggaaaatggataaaatacatgagcagataatttataggagaatatatgaatagtaagcacacaaaaatttgctcaccatctttagccattaggaagttataaattaaagccacatgaaatatcattacatacctatcagaatggctaaaataaataataatgacaacacccaatgttagtgatgacacagaaactgtgtcactcatacatggctaattggaatgtaaaatgacacaaccaccctggaaaagagtttggcactttattacaaaaactaaccatgcaactattacataatcagcaattgcctttctgggaatttatcccagagaaaataaaagctatgttcaccacaaaaacctgtatattaatgtttataatagcttaattcataatagccccaaactggaagacatcctgatatgctttaatgagtgaatgattaaacagactacagtatagccatatcatggaatctcgcttagcaattaaaaaaacgaacctactaacgtatgcaagaatctggatgaatctccagacttacgttgagtgaaaaaaagtcaatccaaaaaggctatatactgtatgaaaaattgtagagagaatactttaatggttgacactggttgaggaagggttgggagttggagggaagtatatgtggctataaagggtcaataggagcaatctttatggtgatgaaaatcgcctgtatcttaattgtatcaatatcagcaccctggttggaatactgtactatcgctttgcaaggtgttatttattgttgggtctctccatattatttcttataaatgcctataaatctatagttatctcaaaataaatagatctacttaaagataaatggctaaataaataatttgcaagctctgaaaggatctccataaaggcaatcacaaaggaaagctcttctaggtttttgagattttttttccatttttcatttaaatttttaagtttttctacgggaaacttatactgctgtggtaataagaaagacaaaatataatatgcttgtaatctaaaatatttttaagatacagtttcattcctgtgttcacatcaatacaatgttctatatatgagaggcaacttctaaattcaccatctgtctattatgaaaaattttatcctgtggtcagggtattttatagctagagtataaacttgtaatttgaataaagagtatgggttgaatagtagatgtgccagctttgctttttttctatcttagaaatttataaaaaattaagtttgcttttaaaacttaaaagtgttagttctgaaccctagagatgctgacctaatggcggcatattatggctgtatgctgccaattagataaaagcagcatcaggaatcatttcatatcgctttgcttggctggaagtgtgtgtgcacacagatacataaacacacttctaatttctgcaaaagatcactgttagttctttagaaaactgctggcctattttcaaaagccgaaaatgagctggagcccagtgctgaacatcagaaatcaagaggcaatctaagtgatggtgacagtaggttttagtgaatacaaaagatgaaatggtaggaagctggataaagataattctgctccaaaatccaaagggcaagagaacataaagatgtcagaggtcagtatcattgaggagggaagagttttgtagctctaattgattctccgggctcctagagggattgaacttcttttggaaacataaaggtagagggcataagcagaaaatatatatcagatacaaaaccaatttctcccagaatacatctcaaaaagtaatgtcattaaattctggagccctgaagcaaaattcttcaaagttgtctccttgcagttttcacaagaaataacctttgccatacgccctgggaaactcatgttttcatccgcaatatggcagtgcttatcagtctgaaaagattattctgagaagttacataaacttgtaaactattaaaccttaagtgaatgtaaaaatgttacgtcatcttcattagcatgcctccctaaaacaatagagagtgcttagcctgagaatctgagctaagcttgaagtgaaacactactctgctgtgtaattcattacttgaagaatttacttccggcctaaattctgtttagtggtaggtctgccatctagtggccacttacataaatacaagttgtgatcataaattaaagaccatatgaaaatactaggtcatccaaatggaccatttctagtccaagtataaaaaggcaaagaggatttgactgatggtaagaaaatttatattcagggatcacttagaggtaagtgtgctgactcaaaacactatgagtacaaaagcaaagtaaaaagtcatttagacttatgtggacttcaaaatgagaaatttatattcataaactttcactaaatttaaaagaaagtaaccgttgtgttaacttatttatgttttctcctcattatcttttagttcaatcacatttatattttctacttaatgtaaaccatgaaataaaattttcttcagtacttggatttgtgctgccaatttgcagaattgtcagttattaaataaaatgtaacacagtttcagaacttaaactctaaaatacaaaaacataacattgttcaccttcaaataatacaataacttttggggctctattattattattgctttctttgttaatagaaatgacaggtaatgctaggcctttgatgctcattctcttggcataatttttagttatttgtccaaagctacacactcccaccctcagttccttccagagtgctaacctgaaagcttatatttgtaaaagccccattattattaaaaagctcattaacatacctgcaaatggtatttgcacagtggctaagtacactgaacacaccctgagaagtatttactaagctaaattcatcagacaagtgtacaatattcacatttcagtgttacaattgttatttttatttatttggtttttgagttggtatgcttaagaagagattaaatctacctccaaattatagttctttgacatactaatcagttacattaaagccatttaaataaataatattttaaaaatccccaaaccattaggcatgttttcattattgttgtatccagttactttccccttaggcttattattattgcttgaaataacaggatgatatcatattgttcaaactggaaatatagataattttgcaattgctaatgttgtgtaaaaatgtcctatgataatccacaaaccaataatctgtattgttgatatcctaacaagtatttgtaaaacacaggccaaataataaaacaattcccattccatacttaatccttgattttatggggtcccatttatttgtaatttgtaaatataatctcttacaatcaagtatgggagcctcaaagtcatgaatgatctccaatttaaggtaagaatgctcatacatttgcttgtggatacatttctttttttttttttttttgagacggagtctcgctctatcgcccaggctggagtgcagtggcgcgatcttggctcactgcgagctccgcctcccgggttcacgccattctcctgcctcagcctcccaagtagctgggactacaggcgcccgccaccacgcctagctattttttaatatttttagtagagacggggtttcaccatgttagccaggatggtctcgatctcctgatctcgtgatccgcccgcctcggcctcccaaagtgctgggattacaggcgtgagccaccgcgcccggccggatacatttatttctaaataagaacatctcatgtggttcctaagactgattatgccaagacccatgtacttcaaaatacggcattccaatgtgtggaattttctttttccactcaatctgtctactttttaacaacatggccaaactcccaggatcttaatgccaaaaaaagatgatttttttttaaaagaaataatttaagatcctaaaatgaaagcaaaatgtccatcctcgtgaacaacaaagtcagtcacaagactgaaaccatggtctataataatttaaatttatttattacttactctattatgtgtcaaacttaccctgagtcaaaatcgtgaaggtgaacgtaacattaaatgtgcgttttctttaaaccacactgtgatgaaatggactctcactcgggagtctggctccagaggcctcacccagcagagtgttcactatcacagaggacttttcacacatttcctcggagaggagggaagaaatccatcaagaaaggggatttatattccaaaatcacaaaatggctactatatcaactggagaaaaactactcacaggaagaaaaacagcacagaacaaacctttagacagtccatgccctagcacaggatttggacagacataagccaagggccaaatctggctctctatctcttttgtaaataaagttttattgtaaataaagttcagtggacacaccatgcccatgtgttcccatattgtatatatgtatataacttctgtctccttttattcattgccttctctgtatgagatatgcatttctcttacctcaatcaataaaatccaacctatcgtgaaggtataactttgtataatggaattaaattgaatatatcatttggagccttgtttttacatttaatattttttctgagatttatggatactgctgaatataagtgtagcttatcaatttccactttttaagtgctatggactattcaattatacaaatcaataaaaattaacctatactatgccaatgggcattgggttggggttaacactttggcttttctcagtaatgtttctatgaatgtttttgtacatatttcttgatttacaaatgcagcagttttcgagagtttttacctaaatgttgatttatttttgacatagttggtaaacacttgacattgtgactttttttctttttggttagtagtaaaaggaatcttttgtgggttttattgataccaattatataccaattatctttttatcattgattgccatttgtgtttcatcttctatgaaaagcctattcaattttttggctttttccaatcctcctctcagtttgcttgtctttttaccttattgaattgaaggtgtttttttaatatattctagatactacctctttatcaattatatgttgcaaatatcttctcactttataacttgtattttgtgtatgaggtttttataaaagaaaattttacggctcacgcctgtaatcccaacactttgtgttgggcagatcacctgaggtcaggagttcgaaaccagcctggctaacatggcaaaaccctgtctctattaaaaaatacaaaaattagctgggcgcgggggtgggcgcctgtaatcccagctactcaggaggctgaggcaggaaaatcacttgaacctgggaggcagaggttgcagtgagccaagattgcaccactgatctccagcttgggtggcagagcaagactctgtctcaaaaacaaaaaaagagaaaattttaactttaatgtagttaaacttacctaaattttatttttatggtatacaattttatattttgtttagtaaaactttctctgcctctgaggtaatataggtattgttccatattataacctaaaaatgttaaataatctagaatctactgttgtacagttctaagaaagagataaatccctttattatacaaataaccaatttttttcagcatcatttattaagaagtctatctttcgtcattgttttgcaacgttaactctatactataaatcacgtttccatagatatgaaagtcttttcctggactctattatttcagactgttctcattggaacaacgtgacaatgcttaatcttttaattctgtatttcctttgtatacttttagccaatgttgtgcttatcagtacagatataaaattgttatatcatcctgtcaaatcaaacctcttatcattatgtattgactctcttcattcatactctttattcctactaatgcattttgtcctaactacataagtattattatgggtagtgttcaccagatacacctttatttatctctttacttttaatatttgtattcagagaaatctgatgtgcagaacaacactgttatgccatgaattagactgttgttgaatattcactggaagagtatttttgtacggccttgctctaaactttctaaatgaagtaattattgtcatgtcccatgcaactgtgtgcatagcactcaccactagcatagctattgactgggtataacatataagacctctcctatctttcctactgaatcttctaaattagttgattactaagttagaaacaatgtactaaacaatgaggtttttatttacaatagcaataacaatttcggtaaataaatagagaaaaacatcacttttgaataacacaattagtagatagagttggaggatggtaaataccagagacaacagtaatctagagcaatattaaataaaagttctgaagattattcagatataaccttacccccacttaatagttaggataccttttaaaaatgcttcaaagagcattatttgtacctccataagtaacaaaatattgaaatgagctattaaaagttataaatgaattcatgaaaacaatgcatttgaaaaaaatctatataataatactgcacgaaaaatgacagaaagacataaaactttacatcaggaatctgtctgaaaatatcaagatttcagtaatgtattttattcacagagaagcttgctctcctacgcaaaatttgtctaaaatgttaccacattagtgaatctaatgaattccaaagtcccaggttcctgtaggttttcagctttacagaaatgatcaaaattgagtgtctcaatgtattatttaattaaaaaaagtttgtctgaagtttacaagccaaaaagtaaaaattatatatgggtaatactttacagatttttttgaagggtagttgtggattttttaaaatgtcttatctaatatttagataagaacccaaataaagtatattgtcaatgtgaatatgtatacttatatatatgtatacacaaacatctctctctcatcacacactctctctctctatatatatatacacatacacatatatatacacggatatgtacacacatacacacatataaaaatatatatgttcaatggatacaaagttatagttaggaggaataagttctagtgtttaactgcacagtaaggtaactatagtctgaactaatgtgtatttcaaaatagctagaagagagattttgaatgttctcatcatagagaactgacaagtgtttgaggcaatggatatgctaattacactgatttgatcattacacaatgtatataggtaccaaaacatcacactgtaccaaatatgtacagttattatgtgtcaattaaaaacaaaataaaatgtgagtgtgtgtgtgtgtgtgtgtgtgagagatagagagagagagatgagtgtgtgttggaaagcttacaattttaaagtaaaaattcaactttggaaaaattcactagtgatgtcagtgttataatttaagtcttaaggagagattaagaagataagtatgcttaaaatgtgtatgcttaaagaaaatcttcatcattttcttaaatacttgatgcttcacattgataattccaactgaattaaattagaaattcatctgcattatcataagatatatcaacatttcatatgttaataagagatttaaagaattctcactctgaaatataatttaaagaaataaaattatctgaactcaggttattgtcaagactggttttatggttttatccagtcaagaaaaggcattcaggacatttgttattaactacttgtgcaaacaatgttaaacatcaatgaagactatcaagaatttggtgtcgttgtgggcagcagtaatcccaatattacttccaaaaatcttcttctccataaaagcaacaagaacactgcaaaaaaaaggtgaacttcaacttttttaggactctggagattaagcaaaaggtttcaattatataggtaatgtttattagaaaaataatcgctgaatcttggtaaaacatgaagttttgtgatgttttaacttgccccaatattgtctccctctctccaagcctgtgattgccttgaaaaccagcagttcaacgatcatagtaaaaaccagaagtgtagcaatgcctggagggagcagaatagatttagagctcctccaaaatctaattcccaagcaactgtcattatttgacttgcttctggaaaatcctatgtgcaaaaatatttggcttgttccctggaaaatcccacgtgcaaaacttgttacttgagctaagtcagagcttatccagtgcagaaagctgtttccctgtaggcagttactacaaagaattagcagcaattgttaaatattgtggttagctgaactggtgacagcagttaggaaaaaacaacaaggcaaccacaaaaaaggaaaagctaggaatgagttattcataggtggattagaaaagttctgtgataatcctgggaatctagaatgccacacttaacgcttacaagtttgtgtatgcccaagaaaaactagagaaggccctatgctgtcatgctgtcatctctagatgatgttgagcttctgtgcaagcaggaagtgaggcctaaagtggtgttgcaagcagcctgactgggaattgaaggtgtaccacaacgtgcaccctgagctcctcagcaaaagctgggagacttattggttccagcctgtaagaaaatctctatcaattttttagctaactaataagttaaccaataagaaagtttagtgtccacccataaaaagaatgctaattttacagaactaattcaggaaagtcattaaacaaataaacaacagcaacagcaacaacaaaaaccaatcataggaaaaggaggcagagagagttagcaaattatattatttaagatgtctagttttcaataaggaattatgagaaaaacaaataaagggccattcacagggagaaaaaaagcagtgaatagaaactgtccctaaggaagctcatacattggacttactaaataaagactttaagcaattttgaatatgttcaaagaaaattatggaagtaagtctcacaaaacaaagacttagaaataaagagacagaaaatatagaaaatcaccaactagaaattttggagttgagaaatactatcactaagcttgaaaattaactagaggtgccccaaaccagatttaaatggagagaaaaaagaatcagcaaacatgaagacagatcaattgaggttatttaacctgacaacagaagtaaaaagaataaaggaaaatgaacagagtgccccagaaacctaaaagataccatcaagtgtactagcatacttaccttttattaactatctatagtcctcatgttgtacatttgattcctagacttatttatcctgcatcattgcaattttgtaccctttgacctgcatcttcccatttccccaccctcacccctggtaaccaccatactactctgtttctttgtagtctttcttgtttttttttttaagattccatatataagtgagatcaggtgatatttgtctttttgcatttggcttatttcacttagcataatgtgctctaggtgattttcttatttttaaaagctgaataatattccattttctgtgtgtgtgtggggggagggggggtctctgtgtgtgtgtgtgtgtgtgtgtgtgtgtgtgtgtgccacaatttattttcccacttatccaatgggtaacaatactttgcttccatatcatggctattgtaaataatgctgcaataagcaggagagtgtaggtatcattatgaagtaatgactcccagattgctcggtcatattgtagttctatttttagtttcttaaggaacagctatactgttttccacaatggctacattaatctaaattcccaccaagagtatatcaggtttcccttttctccacatcctcaccaacacttatctcttgatatttttataagggccatcctaacaagtgtgaggtaatatctcgttgtggtgttgacttgcatttccctgatcattagtgatcttgagcaccttttcatatacctactagccattttacatctttggagaaatgtctattcaagtcctttgctcactttttaaattaggtttttcatttttattgctatcaagttggataattcccatatatattggatactaacacccaattagatatatggttcacaaatattttctcctaatccgtatgctgcttttacattttgttgactatttgctgtgcagaagctttttagtttgatttactcccacttgtttgcttctcttgcctacacttttggagttctatcaaaaaaaaaaaaaaaaacattgttaagaccaatgtcaaggagcatttcctcttttctctaggagtttttcagtttcaggtcttatgtttgggtctttaatttattttgagttgattttgtgtatagtatgagtccaatttcattcttttgcatatggatattcagttttccaaacaccatttatttccccattgtgtcttcttggctccactgttgaaaatgagttggctacatatgcttagttttatttctgggctttctattatgttctgttgctctatgttcctgttttcaagccagtaccatactgttttagttactatagatttatatatatatatatatacacacatacacacacatatacatatatatatacacacacacatatatatatattgtttcttcatttttcttttaaattacatagtaggaaaaataattacaagtaaaaataaatttatactgtatttttatatttaggtatatgttacctttattttccgtatgaatttgtgttactgccaagtattctttccttttcagcccacagaacttcctttaatatttttatgacaaggtctacaaatgagtaattctctaattttttatctggtattgtcttaaattttcctttcatttttatggcctatttttttctgaatagagtgcaccaatatacttaaaatggcagtcccacaaagagaggagaaagagaaaaaggaaaataatttttaaagatatactggccaaagactttccaaatttgaagaaacatgtgaaactacagagccaagaagctcaacaacttccagttaagataaatttaaaaagacacacagtaacacattgtaatcaaactgttgaaagccaaaacaaagaaagaatcttgaaatcagtagcaaagaagtgatttatcatatatgaaggatcttcaataacagtaataggcaatttctcatcaaaaaccatagaggcaggaatacaatgagatgacaaggtcaaagtcctggggcagagaaataaaaacaaacctgtcaaacaagaattcttcatccaggggaacagtattgaatcttagttgacatataattcaactgatggaaacgaaagtgtgtgtctgttggaagagtagtcttttagacctgagaatgctctgctactctgagatatagagtgccattgacatcagtctggaagccttatggtctgagtggactagataattaatctatttagtagattaattatgctttcctcacaaaccactactcagttaatgtctcctggacatggttcataagaaatctttgaggagtcatttgcctatatgcaagtcagcaaaatgtgagtttgaatctgttctgtctttccttgtcccttatgcatgtttcgtttgtagcattctacctctcctcatctttctacgtcttctcatcctgtaacctcttacacaggatttgattctgagcaggataacacactcaagtaactggcccatcattgtctctcagtggttcaaaagaaaaagaattgagtgaataaatcaagttcaccttcccaaaagatgttgcctacctttctgaaggaccaggaccctccactttcatagcttgagtgtaaatagcaatgaccccctagcggatgaccttcagaaagtatatcccacaagactgctgggaattgtatgcctgaggaagatgatcattaatccagaattattcatgttatattgaatgcaaaaagtgagatttctggatcaagtcagaatattatactttctagtgtgatgtgacaagaggcaggtggacaggactttacattcaaaagagcattttgacactaacaaagaaggacccagaggttctaaatctaagaacttatatacatatttttgagaaaggtagaaaaacctttgctctgtaggataaataaattctcttgagaagagagattctaggttcttggcttcttaacactttggaacagaaataagggtctccaggaataaaataagacaatccttctggatttacaacccttaaaatgtctccatggtcctgtgtttcatccctccatgtaatgtaaacacatacctcagggaggtgaatctctccagaatagcctgtcactatcttaccatcctttaacttccaaggtgattcctttaacccaattaccaggtttctttcttcaaaaaggcctaatcatgcagaaactttaaaatctgttttctacagtcccataggtgtacttccgtcattactagcagcctctgctgtgcagtgctgttcaaagattggcactgcccacatttgtatttcaatgtgaactgtatgacttgaaaaaaaaaaaaaaactcctgtagcacccatgtatatctctattcctgacttagcctagacactcagattctgagacattctttcatgatcatggatctatggctcattttctggctattgaaaatgactcttctttggggacagactatccataatggcccttgctatggtttcaatgtttctcccaaagttcatgttttggaaaattaatccccaatgcaacagtgttgagaggtaggacctttaagaggtgattaggtcttgagggctctgccctcatgaatgaattaatgtcattatcacaggagtgggttctttcttgtgggaatgggtttatcctaagtgagtttcagtcccctggccatccactctgttgccttctgccatgagatgacacatcaaaaaggccttcaccagatgacagcctcttgatattagattttccagcctccagaactctgagaaataaattttatttctttataaattacagtctttggtattctgttatagaccacaaaacaaaccaagatagatctgaacagtaaaaaccccagagtggtaaaattctgagatggctcttccttctagcaataccttcacacactcccccgccagcagaactacaccctacacatacatgcatacaaatttactcccaagaattaaatattttctataggttgagtgcacatagaaaacactttacaacaaagaaatgtgttttgtgcaaatatgtgcacattcagcaaatatttgagtgctacagaataagaagagccttgagaaaaatcactccaaagttttaatctgtgttgatattcccgtcattttaatttggtaagaaagaagctgataagtgaactccacaagttcataatggtctcagaagttatagagaataagcaagcatatgtataaattaaaaattatttttcctgtacttttaagataagtacttgagtgcttaacatgtgttacaaaaaccttggatggtctgacctttgctcccatttctagtttcactaccctgtgctttaaactccagccaaaccagcctgcctttatttattcaaggataacactctttcttctactttatgatgtttgcaatttctttacccctttcccaaaacatttttttacatttccccagcttggtataaataaatttctttgcatatattttgccttacacttaagttctatttacttaaaattgttaatcctgattgaaattatgcttggtttgtgtgactacttgattaattgtatctcctccaccagacatttgttccctgagaacagggaccatatgtttatgtcacctattttattcccagtatataggataacgtctgacatgtagggccttaataattttggaaaatagagtttgtaaataagtcagaaaagtatttacttagaaaaaacaaagttgtgagtccctgtttatcagcattcacgaaagccatttacaaggtctattgggagaaggtacaatgaaaagagggactgagaataaactatgatatttattctcaagaaaccaatgtctagtagaagagatacaattaatcaaataatcacacaaaccaagtacaatttcaatcagagagtaaaccttcaggttttttctggtcagagaaagatcctggccagagaagtatgctgctgcaaaggagtccgacaataaatacaattgctgggacaaaaaccataagactgtggtgttgtggagcaagtggatagtctgtttcaacagggatggagggcctaaggaaagatcaagcaaggcaaatactgaaaattatgcattggatttagcaaccagtggtcactagcagctatagtgaaagttgaaatgacagctaaaggagaagaagccatatataatcagcaaagctcagacccaatgctgaactacagactctaaaagaattttcacctcagaaattatcacttaaaataagcaattttgtctaatatcatttttagacaatatagcacagtatagatgtgaaccttatagaggcttcccaaaataattacctattagtaatccattcagttatctttattcctgttgcttggctttatttcatacttcctagtatgaaagcacaacacatagcagatttctttctaaaaagcatggcaacatatcctgggctatactctgtttgctaataatccatctcatagctcttgtgagtgcataatactcattgaaatcaataagaattacgggcacagaagtgctgcaaggctaagtttttaaactcaagaatatattgtccatacacagccaaatagcacttggatagtctgtgaatataattataatataacccattatgtcttctttcagagagaaagaaaaaaatgatgtaaatttaaacatagcatattctggaaacagtatgcttatggaacagccagagagattttcaaaacttgatcatctaaatgcagagaacagtttcaaggtatgagcaatgcattaagaggccacagatttgggccacatgaatgacctgggagacactttttaaaacagcacaaaaatagcacaaaagtagcacatttttctttgtaaaatatttcagtaaaataattatgcctacatttctcactaaacatttgctgtgcccaaatggatagatttcaaatagaaacaggctgggtgtggtggcttacaggtgtaatcccagcactttgggcggccgaggcagccagatcacctgaggtcaggagttcaaaaccagcctggccaacatggcaaaagcccgtctctactaaaaatacaaaaattagccatgcatggtggcaggcacctgtaatcctagctacttgggaggctgaggcatgagaatcgcttgaacactggaggtggaggttgcagtgagccgagatcatgccactatactccagcctggtgacagagagagagactccatctcaaaaaataattaaataaataaaaactaaacaaacttaccattgagtgaaatttacacattacaagaatttaaaacagacatatggaaaaggacaatatcgactgtgtcttttttctcagatttatggtgtacatacattctattctctgtcctcatacagtggtccatgagacatgggtcctcacagcacctcattattcaccagctgaagcctagtttttctagaccagcactggaagaaccaggttaaatacatttatgttgaaaatcaggctctatcctgccttttccccaccacaaaggtgaagagaatccctcagtatattttatgttatgcaatcaatgcaaaggaatgaactttgttctaggcataaaaataacttaatttgctgtatgaagtacaaccgaggatgcctcacttcatgctgtatctgcatgcatactttcaaaatgacattaaataatttaggtagacttgggcatatacatgtttagtttagatggaatatctaataaaactaaaaggagcttgatcatattggccactgataaatggagcctacagatgtcactgcaactagatatcactgggatttagagaacagatcaagagcttccctgtatcttttttgtttaaaaaaagatgaccctttattttctctatatataacactactgaaaagaggttcattgagactttctcatcaatcagaactatctaaaatgcaatcttacagctgctatatgatataccaccagtgtgaaataaataggaaaggaaagattaaaaaggcaatatttacatttagctaagattatgagtactctctgatatcatggataatgtaaataatattaaaatgaatattattgcagactaattcatttgtattgttatgatcaaatagtttttggagatacatacataatagccctgtctcagttagcagtgtagtgacatttattcaataccaataataaaccaggtgctgcaacagaagcagaccagatggtccaggagtttccacatgagagagcaaacttgggcaagtctttgaatgcattttatttcaatctttcctttattgcaatggaaagctgtcaacaggagtaagtctctatgctgcttaaggtagaatgagattaatggagcattatcaatatctccactaatttttattgcatatgttgccttgggcacaagttctatttttatggtaagaggaacatatatacagaatgttaacagattctgaaaaagcaacatcctgctgggtgaacacatgttagccattgccacagtagtgaactataaattaatattttaaagaactgccatttgtgtgtaaaaatatcgatctataattgtttcttagctacacacacatacacacacaaagcaattggatgttcttagcaagaatattcatatcagaagaattctaaatgcttcaaacgaggaaattattaaaagaaaataatataatgtttacataaaaattctatgtagttattaaaagaatggggtttataataagattccaaattggaaagatatacagagtgtattgtaaaatgacaaaaaatagtgaaagaaagtttaagagaatataaagcaaaggttaaacatttggaaatctataaagtctagcaagataacattaatgagaaaagtaggaatccaagctgattttccctagaaaagaatcttagacaaagcttacgtgctaatactttatttagagctgcaatcccgaaccagcaagcacagggaaaggaaagagaggcataaaaagtgaggcaaagtcaaggtttatctggccacaacttcaggaaaagacccaactggttgcttggccatagaggacatcacgtctttagggaagccaaccagaaactccatgcctctgtatatcagaggaagtaaaggaatggaatttatttgctaactctagatgtcttcttccctcccttactgattcacattaggattaactcaggaactaactccctcactttcaggttacatcacctggccccttaggtggcttctgagaaaaccaaatctcatgtcctgttgaaggacactttacatgagtaaagtaagaatagaatggagagcctctttaaatctgactaggttgatggccagagctattatggctcctggcaggcagaacggagcaatggaggccataccaggaagcccattactcaccccagtagcagccaagacacacagaagtgttagaatctgaggtagattcagctgcagtggtgacaccagcaaccaggatcctccatgagctagtgaatgggggcccagtagacagatgaagctgagtaaatcagagcaggctcatgaattgaacctggtatgttaggcaggacaaattacagctaacacatatccagtgatcatgaggagtgtggaaagtgtgaagaacataagacagcatgctgctacccagctctaggaaactactaccatgcaaggatattggtctatgtcacctgactttccaatttttcaaaaagactataccttcattttcccagtgagaataatcacctacaaactggatctctagagtttttttacataaaagagaatttctaaatattggcttatcaaaaaaacaaaacagagtgtagactaaaaagagatctgtttatgagttatactcaacccataggttactgttttacaaactctgatgtataaaacaaatgcgtttaagaactcaatccaaatctctatctatctatctatctatctatctatctatctatctatctatcatctatctatccacgttgctctccaggttcatacatgcaaaagaaatgatcagctactttgatctcataaacctagacaaacacataactctatcacataactttatcataactaacctctaattattcaattataccttcatttatccaacaagaataatcacctgcaaaaaaagtatactctattaatgtataaaatgttcccattaattagtaatataaatcaatatgtggacaagatatcagatttctgtcttcctagagaccaagaggccagtgaaagccaagaagaatgtccttaagtagaaattctcaaaaacatgtcacaaagaattttagtttcatttgaggtccagggattatggaaataaaagcaagactagtaaaggccagctgttttatggtgcgctgttcttcctaagacaaacaccagcttcatgtaagcctccaggcttaaggtgatacagaaagacctatgcttaccaacttgaaaaaataaaaatttcaattcagagatgataggaagaagtaacatacgagagaaatatacaggaaaataactctaaggaggcaaaggtgaataaaaatcattagtaagtgactcattttttgtaggaggagaaaaatagggttgaaaataaaggcttcatcttttgttcctcagatagagactaactgtacatctgattcttctgaggattgagaaagcaaattttactatctccctttttgtttccctgtgtaaagacaattaaatttcagtttatttctctctgtgtggggattgctcaaacattttttcaatattccaaattgtattgacatctctcatccaaggaaagcttttttccttaattctattctcttgtgttgatatattttttcaaagcgtttttaatgagatctgaagaaagagccaagtttaatctgcatataatctgtcatctgaaactatcggaaggacaacccttagttttgcaaattctttcatggaagattaattataagaggaatctacctgattaatttggtgaattggtgtagtccttgtagcaaaaccagacaagaagaaaacaagaaaataaaaacatagatgagtatcacttaggtacacagcagaaatattaaataaaatgctactagcaaattgaatctgctagactgtgaataataataatgatctcagaaatacaagattatttaacatcagataatctataaaaaatttaccatatttataaagaaaaacacatcttcccaatagttttcaattaaattctacattcattaataattaaagacttagcaaatatgaaacaaagagaaacctcctcagccaaataaaaattatctatccaaaaatgtatagcatatataattatatacaatgtactttatgtaatatattttccaaaagtcctatgagcgaacattgtaacttcatgattattgcattgtcttcatcattttagtgagaacacataatattgctggatcttattcttccttttgaaggttttgaagaaatatgttttcattcagctggacttctagataattaagatgatagagtagtttttcaactgctttaggaataagtgtgagtagccagcacttgaaaatcaaatctgccttttatcctgcccaagacaagttttccttttttgctgaagagttgtttccatcacgggaataatgttccttgatgctaacatgactccctactttgttttccagcctgaatttctaaattggcactagatccttggcttaccttctcggaggaggctggattcaaaggtgatcctaggtgctcttactaaatcagttagcatagagctagtggaaacatcaatggttttacataaaaaatttcaaagattgactgtattaaaagcattataatataacatagtacattgttttcaacctactctcacgaaataccagctgcccaaattaatatacttcctttctggtagttgactcttgtgtttttgtttgtttgtttttaagcacacaaagggaatgcatttgtgtatattctttaaagtgtcatactaacacacattttaacaagcaaaaaaaaaagaacaacaaaacttcagtgctatgtatgtatggtctttacattttatcctacgttcattttatgacataaaaactatcagacatattatctcactacacttcagaccaaatagtttgtttgtttgtttgtttgtttttttgtttttaaggcgaagtcttgctctgccgtcccggctggagtgcaatggggtgatctcggctcactgcaaccttcgcctcccgggttcaagtgattctcctgcctcagcctcctgattagctgggattacaggcgtgtgccaccacgcctggctatatatatatatatatatatatatatatatatatatatattttttttttttttttttttttttttttagtagagatggggtttcactgtgttggctgggatggtctcgatctcctgacctcatgatctgcccaccttggtctcccgaagtgctgggattacaggtgtgagccaccgcgcccagccaatagttatctttttaactaaattcctatgggcatcaaatgaacaggaagtagcgttcagataaatggcatattattgattgattttaaacacctttctacaaattttaagtgacaaagaagcacatgtatgtacacacatgtatgtatgcacgcatacacacgcacacatacacacacacactcatatattgtcttgaagagaatcaggcctgggttgtttccaagaaatcgcctgaaagtggtttcatggagaagaggagagaagggaagggaaggtaagggaagggaggggaggggaggagagggaagggaaggcttaagcaccaggggaacagtgtttcatataaactccagtgagaaatggcagaaaggcaagaatacaattagaagaaaaaagaccaccaaggtcaacagaatgaacagtttctgaagcatgaacaaaagtaaaataacctgtagtgattacctgaccgccagttcttgcaagggttctggacattttgagataggactggagctactaaatgtactgaagcggtttgaataaatactgaactagccagttttggaatgatgacttaagttctatgatgaagttcagtataaaatatggatgagagtgtcacaatgactggacttctcttcagaattgcactgcgaatgtatccgataaaatttccttgatgtaatttctaatttatgaccacgggcagtccttttatatttctgttcaatcctcctatttctgaaacatgcatatgaatcacatccctgtggttatagcattttactgaaatctggttgtattaaacattacccagcatataaaatataatttaatagctaaagcttaggcaatattttgctataaggcaaattgctttaggttgcactttgtagaaaacatttcacctacaaataatgatttaagaaatccaaatcagcctatcttctcatgaccccagcatttagattagtatttttcttattatccattgttactgacaccatgaaaccagtgttgccgacccatgtgacaccctgaaactcagtttctttagcttgcttactacactgcctgacttcataacagcacttatcactcagtatttctccatctccaaaatctataaacttatgtgattttaatcccattctcattacctaatacatttctactttatccacataaatatctatatatccttacttatctagcttaattctgactgttctttactcactacccagacaaatattcagtttagttgcatcattattaccttcactaactgtctgccttcctaaggatttttttccctctcttatcaccatcatcattcccaatgtttgctgggttgctaatagttgatcctgaatctttcctaccacctttttcggttggtgttaatgttactggcaaaaggcagaagaactgccctgctgtaaatttcgacatctaatttcaaccagagtttcattagcaattggtattcctttattcacttttgtattgcttttctgatgaattctccaataggcctatatctaatccttctcctccaacagccaaaatcccacttttattttctcaaaagcagaagttatcagaagacatcagccacgtgatgttacttcttttatctactctctccgtatttcaaaatatttgttacggtaatacccttatttctctctattagaatatgtatatcctatatttccaaagcttgcctgctgtttcttttagacttgctatagaacacacagttataacaactcttttggttgtttatactcatttgattgttgctgtctttttactttttcttttttttttttttttttttttgagatagagtttcactcttgttgcccaggctagagtgcagtggtgtgatctcggctccctgtgatctccacctcctgggttcaagtgattctctcgcctcagcctcctgagtagctgggattacaggtgcctggcaccatgcctggctaacttgtatttttagtagagacggggtttcactgtgttgcccaagttggtcttgaactcctgacctcaggtgatccagccaccctggcctcccaaagtgctgggattatggtgcgagccaccacacctggccttgccatctatttttaaccaaagaaagctattgcacctactgcaaaagtttaaacaaatcattgtttaacatttatgtactctcttttatttcaaacatcctacattgcttttatttcacagttccatacaatctcccctcaacactgttaaatcaagttcaggctaaaggtttctcagtacaccgtgaactaaaacctaaatggaattgtaaacagacggtagcctcctcttgtgtcaatcaccaagttttggctaaataaatgtggccaactgttgttagaatcatgttcaaataaggcaaatgccaaggtacaaccaatctggctgtttctgtaccaaacttccaatttctgtgttttacttttcctttttctgtccataaatcttctaccatgtgactgcgctggagtctctgagcctactctggttcggtaggctgcctgatttgtaaatcgttctttgctcaattaaacgcttctgaatgtagttttgctccggtttttcttttaacagcacctataacataaatttttacttctaccagactgggtaatcaaacttttcttcacttttagttaaaccattgattttttaaaaatcttatttgactattttgtgctgtttgtctggcaatattttcattttctttccttgaaactctgactcttctaccatactacttctctttcctctcatcatcttttgtgagcactccctgaggcacatctgctagtcttacgggtgagattttaaactcttttaaggtgatatcaattaattactcattaatcatgtactaaatgtatattagttcatagattttctcagatgaatctaatttagcaaggtttcctccttttagtgtggggttcttttcacactgtatggactagaaatgtaaatataaggaaataaagtctctactggtctccactgctgaggtctaagctacgcttcatgggacaaaccattaaaaattacaaacaaaactttagtgtttggaccaggatcaaccatatagatctatgtccatcactgttttctgatagaagatccaaccattaatgagaaacaagcattatggccacacttgaaaaggtcaataagatgcttcagaacacaaaggggaaatcattaatgacgttagatgaatcagtaaagaatccaagtcaatccccatttagagaacaatataaagactaaatgaatttcattataaaatgagcaagattgtaagtataaactaacagccataaataatacttcaaaatgcggctatgcttcaaagtatattacaaaatatatttctgaatagtgataagcccagattttctgaaaggatttttctgagttttcaaaaagtcctgggtaatgcagggagcgttctcactcccatgtaaacagaggagtaattatggaaatattatagagtaatcttagtggacaaaaaaaaagataacaagggccataattataacataggcttaacctcaaatattgaaacatcaccaaagaaagatgctctggctttgaacattgtttttataattaatttttttctttaataaaggagaaaattttattaaaaatcatgtctacaattacctaattttgttaacccatctgaaaaattatgaacacctagggttaccaagcaaaatacttttattatgtttttagcataatttattcattaactgaaattcaaatgtaaatcaaggttttgtatttttatttgctaactctatcttctctgtagagacctaatgatgaatgttattttatattcatattactgcttgttcacctttacacacccccatgaagaatataaattctagtagagaccacgtatttcacatttactactctatcttcagcatctaaaaaccacaaattctaggcccaaatttggaggtaggactatgatcaattttacagacacattgtcatctttatttttaataaagctaccaagcgtgaataaaaagtaaataccatcatcacactccaaaagctcaataagagctctttcacagagagtagattcttctaaaatagttgttttaaataaaagaatgaaaatgaactactcacattacttcatctcttcacttctaggctactccacatagcagtgaagtgttctttggttgacaatgttacctggtagctgacttaaccagtcaacacatctaaatttctcattcagtctctcccctctcccttactgttcaaaagaataatgacccaatgtgactgagaaatcacaaaattttggaacaaaaagggacagaaaatatcaggttaacctcctttattttacagattaaagaactaaagctcacatacctgcaagagtgtttccctgatccaaacctttcaatggttctgggtcacttataagataaaccttctaaagttttggcatgctacaaatgtcctccaagattctgccccagccttcagctccagacgtgtatctcctcataggaattaatactatctcctggcacctataaatgacgagtatccctgtgctcttagtgacccaaaggtgaccacttcctcccttgtacttacatccattcatacttctattatagcacttttaagattatggaatgtagaatggaatttatcagtttaaatgtctgtctcctcttactagtctgagtacaggaactacagcttattcctgctggaattactaatgtctattcaagtgcctggcatgtgccagggcacctggtggaagcccaatatgcatttgacaaatgaagaaacacatacataactaatggcacatattattatataattaatggcagaaatgaagactgtgctttattaccaatccacagaattaagctaagaatctatcaatatcaataaaaaagaaagtaataaattttgagataaaatttgtcttaaaaatcagtgtcagcaatatgtcaagcttacaaacatgctgagaaagcctgctctacaatgttcaaaaaaatgttgtttttcacttttctgtccactaattaagcttgattttttttccaggcatagttttgaacatgaatatctatttcttattcctttatgtttaatttctatagtacagtaagtccttatttaaattcttccatagttcttggaaactgtgactttaattgaaacaatgtatgatgacacccatttttttaaaatcatcaacattgtaagaaaacaatgttgaataaaacaacattatttgagggccactaaagtcacagtttccaagaacttgctgaaaacattagtgagaacttgctgtactatattttgtaatttttcattatacacaccactattttgataataatgtggattgagcagattatggaagagaataccttcaatcattttgcttctataacttaagttctcaactcctaacttaagaatggatttctagaatctaacttgtgtgaaaactaagacccaccattgtgtatgcaaggtaggaatagaaaaaaacccatacacaaaatgtaaaccaaaatttaaaaacagttataggtacaatttccatttataaacacatttgaaataaaactttaaaatttggtaaatgtatgttaattgatgcataccagcgtcatcattttttaattttttaaattcattgcgatctgacttataataatataaaatgatccatttatccataaagcctgtcattatgtgtagctgagttatttatgtgtacatcttttaacagaacttttaagaatagtaaagaaaaaacaatataaaattggtgattctttttataaatacaaacgtcaccatttatttgctatgttcaagtcctaattatgtacaaggcactgaactaaccacattatgtcaatttaaaccttgttacactccagaaaaatcagcaatatcattaccctctaatttgaccaaaaatttagtggatatactcaattataagagaagtacttttgttacataaatattacttagaagtgagaagtgagaaatttagtccttttactaggtgtgctctaaattattttattttgatcaccatacttagggaagaatccatcaatcatagcttggggtaattgtagcgataacctatatgcatttaaaagaaaaagtcaaggaaatataacaccaacttagtcactatttctgggatattatctaataattgttaactattggacataatttcaaataaacctttcaaagactgccttatcagagtaagcagctatcttgtagagatcatgtatatgtgtctacagaataaatgagtgaacgggaatggcctaatttcgtgggacaacactcatgaaataaattttccagtgataatatcacccatagattcatacacttgagtatttcagagtgttatcctctagaaaactgtttaagaggactcagagaagatgaagctactgatatctcaagataccagtgaagaacacaagggaatgaaattcatgaaatgtgatcagaaaccacttcataggttttatataattttaacataaacatatataacccatatattaattaatttgcagagatttggccatatcatctacactcttagaagattttgtcattaaactggccaattaagagaagattttctttgtaaaatgaaagattggcttatattttctggtgtttcttattcatgggcatgtatcacaacctaactactcttttgtaagctttaaggggtagaatcagactgaccagcatctgcctacctcaacagcctgccttttaattactgtctattaaaaatgtatattcactctccctcctctaaacttttcaatataattagtaaaacaaaattataccttggtagtgtctaatgctttctaatggcagtctcttggcagataagaggatgtgcatgtatattcagttgccatgtagcatctcagaactgggtatgattcagtgagtgcaaatgaatattatctaacacaattcactttaaaagagaaagattataagactaactaaggaagaaaaagaataagcttttctaatatatcatttatttaatatatagatatatatctaatgatctatctaatgatatctacctatctatatatagatatacttctaaaaggtatgtattttgatccttaaaagtcatgctgcaattgggtaacattcttaaaacttatctatcatattttataaaacaaaacatgtgtctaggtccgtcatagaagagatatttactgtatgggattggtacccttcctttatataatatgcaaccaaagaaagaagtgtttctttttgccaaagaaaaacagtatttaaaatacacaatatatttttcacccatgtttgagatatccgcaataaccataaaacagctggagtgttttcccaagcattatccatgtcttagccatattctttgctctcatgttattcctagcccccaaataaacccatcttctagacatgtcatcaatttaagtatctatcttgccaaataacaattccaacatttttaaaaactgttgcgttttacattgtgaagctaattatggcagaagtgagaaaaggagtaggcaaaattttactgatagcttataaatataataatcgctttctaaatatataaatttgagtttcagaaggactagggcttgtaatgattatgtggtcttgttgttctattgtgctaatttgaattgaaatggtgctgcaatgccaaaaccactgcttttaaagtaattttctacctgatttatttactcacattaataaaaaaaatattgtgctgtagtcattcacagaagctgaaacagcaaaatacaaactagtccaccatgatctaatttgtacttgccaccacaatatttcttccaggcacaatcaactactctgtcagcatcagtgaacttctctataatgtttaatgagaaaatgtgaagaaagaatatcaaaaacatttttatcagggctcaattttccaacccacttatagtttcaagattcctaggcaatagatgaggctcaggaaaaggtgaagaacgactaatgatcttggtttctcatctgcggggtaagaattaagtagacagagagagagggagattgtacaggacttagtaattttgtagctactcaaacaagggaaagagaaacgaaaagaattctaaacctgccaatgccactccctttacatattaacaggaaatagattacaaagagaaaggacaacctcagatgattttagcatcattttagcagcattcctaggctgataatatactagaaacaacatggtaaaacttaactaaaccataatacaattgtcactaaatagtaatagctaaaataaatagcatttatatagtactgtgcagtttccacacatatatcgccatgggtgcttctatcatcttcagtgaatagattttaaaaaaataaacctttccaaaatagtttgagaaagaaaatcaagaacacgcttgaaaggaacttaaaaagaagagatttatataaaagtttataaatgggtagaaagtaaagtcagtatacattttgaaaagtgacattttatggccttctgttacatttacagtgcatgtaaacattgtttcaaatatataattaaacatgacgaccaccaccagccctcagccctcagccgcagatatacttcacccactccacattctcacataagtaccactgttttaataacatgaggatttcttccatcctagtcaccaaagggcccaggggacactggagtggatagctttagtctcctccacttcaatgtaccccattgcatcccaccaaaaccatcctaagaatactcaatccaagtaaaatgagtatatattttatggtatatttatagtaaaatataccatgtataaatacaatatagtatatttttatgcaaatgcatattttttaaaagtcctccaatactatccccatcttctaatgagctggctatatctaacctgccatttagaagctctggatatatcaatacattaaataattttccagttaaagtaataacatcatttctgccatgagtcacacatttattcattgaacaaatatgtaaagggcctactttatgtcatgactcttctaagatttggtgatacatcagtggaaaaaagacaaaattcttaatctcttgaagcttacactctagtgaggacaaagacaaacaaataaattagtaaatgatatagaattatagcaaggtaagaagtatggagagaacaagatgggagtcagttacaattttaaatagggaacctaaggtacatctcaatgataaggtgacatttggaaaagagttgaaggtgagagagaggtcatgtcatgcatacatctggagtatggaaagagaaaagctagttccaaagccccgaggcaggatcatagccagcgtgttaagggaacagtaaggaaggtcaatgtgaggaagttaatggaataaacaaaatagagtagaaaacgcagtcagagattacaaggatcttagaagacatgttttgaagagcatgaaaaaaatagaggagtcagggataagccaattttttcatattgccatattttatagtaataagctagtttctgcttataaagaaatctgggacataggacagtaaaccatgtgtcctccggaaaactttagcatgtgtttctcacattaggttaaaacatgtatgtgtagtagctcgtatttatgcctttcctatagtgtttaacataaacatttaagtctatcctacaagcaacttatatgcaaaagtaagagagacagagatagaggcagagacagagagagcactaagaagaaatgtagtggctaagaaggctttactctgacttggtgctcccttctggctctcggatcttaaaatcacagtaaatatattgctgaacaatgaatgataagaaaatgcatcgaacacacataatacccagggtgggttaatttttaattgaccatttaaaataacaatattgcacaaaccagctggagtaaaataagggtaagtatgataaggaatctttaggcattaaaaataaactgtatcatatatgggaagaaatggcttaggtatgccaagaagcaggacctcaacacacagctgatatggggaaaaaatggcaatgatagtggaaccacttcctataatttactaaggcaaacgagataacaaaagcatctgatttagagtctttgcttactctaaataattgcacatcaattgagtccagggttcttgcattgagaaataagggagtactactttttaatcctgacaggaaaattaaaaggcccaagttattacataatgtaaataatgtattagagttagcaatgagaaagacttcctttatagcaaggcttatttcataattccagggtaaatctattgtttcgataagattttttttcaattgatacataaataaatgtatacatttaggtacactcttacttttacagaaatttaaatttatgttaacgtaccacttaaaattgcattaaataaaatagcataatatgtgtttttgtaatgtaagaaagatatcagtgtatgctaaaatatataaaatccgatgctaagcaaatggagtaaacaacaaaaaacaacatagccatataaagtttacaaaataattcacatgtagtttacaattgtgtttagaacgtgatctactgaaaatgatagaattatttatagcatctctttggggcctaggccaccttgtacatatagaaagccacagttcttgggtggctgacatactctgaaatgttctcagattttaaattgtagaaacaacacttcccataaacagagagctctctgggggcatctataggactaagtggtaattctcagggaagcaacgttttgggaacattccatcatactgtaccattaatgaattgcctgatttatgaccaatgtaaatttggagctagctaccttcccagaatgcttccaaacggcagcacagttgcaacagtaacaccatcaacacaggaaaagacagcagcctgaggaattcacaaatggacattttggccaaggcgtgaacatataatggatgcagagttccaaaggaggtgctagacttcaagcagcacataaaaactgaaatactacatatgagtaatgttacacttcaacctttgtcacacaaaagctctaaagggctccagatatggggacagcagatatgggcagcatccttgaagcaattattttagagagagctctgctgtgagtataacaaaaaaggaagactgggaagcagttccctaaccctgaactaagatttctctgcaagtacaaaaaaagcttgaatgagctacctgcagttgggggatgctttggcctggagcctaattcacatctgaaaaagctaaagaggccagtgagtaccgagtacaagcctgtgtttgagtttaaaagcaaccccttcacctagatattgaaaggggatgaattccagaagccaaccctaatatctgcagtagaatcttcagtgtggagccatttaaaaacaggctggcccaagagggcaacatgcccggataagagttcctggtagtaagaggtggagtttactgtgggagtccacgatgatggggaacaccaaacaccagccaattccacaacagagttgcaatcggagggacccaacaggcaagtttttcttcaaaaatccttctctcatgtctactgtccctctctatggatgtgattatgtggttcaagaattgttgaaccaatttcagattataacttttgtgcatgtctaacatttcctttgcagtcatagcaactattgtttttgggttttttttttttttttttttttttgagacagagtctcactcttttctccagactggaatgcagtggcgcgatctcagctcgttgcaacctctgcatcccaagttcaggcaattctcctgtctcagcctcctgagtagctagggttgtaggcacccgccaccacgcctggctaatttttgtatttttagtacagacggggtttcaccatattggtcaggctgatctcaaactcctgaccttacgtgatccacccacctcggcctcccaaagtgctgggtttacaggcttgagccaatgcgcccagccagcaactattgtttcttaatgcctcagcctaataatacttatagtaatctgttatacatgtgtgctttaaggattttaaaacctctccatttcttagccagaacctaaatattcaggttactttgctgttgttaattttttaaacatttcttattagcatccctagaagttttatttctattttaactttcttattattttggctaataaatataattacttttatatttcggagttgtgtttctgcttaatcttttttttgatgcttttgaagagggtgcaacaaagtaattgagggcaaatgctttcagtagtgtgctgttgtaaaagatttttaatttagtatttgaattatgtattaatatcatttcagtgtagctttctttcaggaaaatattaagagatagctaaaaataagaaatgtccttttttgggcaagcatggtggctcacacctataatcccagcactttgggaggccaaggtgggcagattacttgaggccaggagtttgagaccagcctggccaacatggcgaaaccccatctctactaaaactacaaaaattagtagttttagtagcacatgcctgtaatcccagctatgcgggaggctgaggcatgagaatcctttgaacctgggaggcagaggttggaggcggaggttgcagtgagccaagatcatgccactgcactagagcctaggtggtagagagactcttgtctccaaaaagaaagaaagaaatgtcctttttgccccatgttacacaaatttgttgtattaagacatattaatgtattacatttattacaatatcatttactatattctctctccaaagttttacagttaaagtagttttgctttaatttaaaggtattttctttttactgaattttctacttataacttcataggatattgagattacatttaaatgggcaaaatattttattataatatcatgtatcctcatatttgaagatgagtgtagaaaaaaaaatccccactacatcatgtcccatttagtgttccaaatttctttatttgctttgatacatctgactatagcattatagatttaaatattttaaaagcaaatagtggttaatttatatatcatactagctagatgaattactgactacgctacattttttcctatgtcagggaaaagttagaacattgtactagtacttaaaatagatataagcagatgatctccagtatattttcattatatccagtatatttcattattatcttataatacagtatgagctaagctaatgagaagaaatattgaaaccaccttgccaatatcagtaacattgacctaccttggcctcctaaatcagttttggactcaaccatcacatactatgaactaatttgagactctcaaaccttttatttcacagtatttcctagtgcctacgattgtaagacatatttaagggggaaatgggtgcctaaattctcaattcacattaatgcgtttaatgtgtaagaaagggtagtaggctactgctttgcaaagcagatttttatgctttggcccctagccatacctgaatttcttagaaggaaaatgtttcctcccttagaagtgcttcaagaaagtggaattcaggaaattgttttaaaagagtcacttaaaatatgaaatcagcagaaattggggatttagttgatagtagccaaaaacattgtaaagagcactggaggctgtgtaattttgaaaggattgtgtttgtaggcattgtgttcagcagtcaacatgagcaaaaacgataagaaaaaaagattcagcagaggctccattgccagggatgctagcagcctgccaaacacacagaggtagcaaccattctacctctttggctgtcttcagggtaacattacccttccctgctaaacaaaggaaaaggtgcccattgaaatctgcagcatgcagtcacacctgcttaagttgtgcttgcttttccttcatacaaaatatttgtgtaactgcaagcagagggttacatctccacctagcatataaaatggagaaacagcatatattataatttttcacaagacagacaataaggacaaaaaattttagttaagtatattttactatgttatttgtgattgtatattgaatcgtattgtcatattaaatttatttttacttcattatatatagataggctgcctggacaattcaaggaaatgtattcctcttgttcctagaagtacaggttgtctcctgtcttataagacagctatttggttagagcagcttctgattttctacataaggcttataatttaaatatttcaggaaagagagggagaaaaaatatatattatatttaattagtggattttctgaacacaaaatgagaagagaaagaaaatgactcttccttctggtttcgtaaagggacatactaactttgccgttttagtctattagctagaggaactgagcagcttcctaggatattctaagtaaaaaagaagtgatgggcataatccccattgaaaaatgccaggtggctgcctgagggtagaggagactctcagtatatataaagaatttccctcaaactagctctcaacccaattccctatggactcatgactcatgagtaagtcttaggaaaaaaagacactcactgaaaaaacttccaaggttgatgactagatagatagatagatgcatagatagatagatatgcagaaatttctgttattgtgaaatataaactaatacttgaaaaaaaaggaagacttgatttcagtcctcattggaatctcatgtgcacagagtaaggaacaagaaataacagggatgatggtttccaatgagaggtgaaaatattcaaaagatgtggctcaactgtggacactggatgccaccaggaggcggtgtaggaagcaacacgtgcatgatccaatctgaagggaacatcagcaggggaagaaatagatgctgggatattgagttactattttttcagtgtttgagccaacccaagcaacgtgctatgccctttacatcagttacctcaggtgatccctataattaaattagatattataattcccaatttacatatgatgaaactgatgatttaagagcaagtatttgaggaaactacccacttctggtatcactgtcctgtcacacatgaaaatatacaatgactccatctctgggaattctggaaatcaaaacattacattgcaaatcaatattagaagaccaagagcaggaaggagtgtcattactcaaaatttataaatagaacaatatatagtaactgttaatacacaaagctaagatggtggtagggagattgttagctattcatgatttaaaagaaaactataaggtttaagataagacacaatgaaattattaatagcactaaataagaaccatggaaggaggagtggagtttaggtatcataggcttatgtcatgattacacccaagaaagaaaataaagatttcaagaatgctgcccaaggtggaaggcacaagtcatgtcttgacattgtcaattggcattaacaattacattctggaggaatttcactgtctccctctgcttctctcacactacctctccattccctttttgtacagatttcagaagtagaaagcaaaggaaggcaaactctcaagcctcctgtgcttttactttcagttattttattactggcctcattgtatgtggaggctaatgcaaatccatcttggatgctaatctgccgtgttgactcttgattaacccctgttcagggaaagcctctcagagttctaccttgtctgttgttagggtaaatcctgcccttaggccaaacatccttgaccataaatcctgtccttaggcaaatttacatagcattcttgcttttcccttggaaatctgtcaacttcaatccgatctttgtatgttggttatgcgggaagagacaacttatatctttagtttacaggtctacaaatcaagatcaacagtactgtggtatataagacctggatctggcaggtaattgtgtggggatccaccatcatgtctcactgtcacccatgactagggcttctctttggaaatccatagtaaatgtttctttctgaggaactggatatgtcagcctcttcctttggcctcttagcctccttagactttggggataaatttgcacatatctagctattgcagaacagcataaaaggtttttgttttgttttgtttttactaccaagcatcataacaaattaactggatttttaaaaaactaacataaaatggttaagcaatgcatccacagctacacagttaataggtaacagagttgggatgtaaacacagtctgtctgacttgaggagccattttttaatgctttttattttaaaataattaaatattatattcacaagaatttgcaagatagtacagagaggaacctacacccttcacccagtttcttccaatggttctgtggtacataactacattacaatataaataccaggaagttgtcattggtgcaataaatgtgtatagcttcatgccattttatcttgtgtatagattcttgtaactaccatcaccacagctaaaatacagacctattccttatcacgaagatctccctcatattacccttctacagtcacaactacactctcctccaaccatttctaaaccctgataaccacttacttgttctctattctatagttttatttcaagaatcctatataaatggagtcatacagccgggcgcgttggctcacgcctgtaatcccagcactttgggaggccaaggagggtggatcacgaggtcaggagttcaagaccagcctggccaagatggtgaaacgccatctctactaaaaatacaaaaattagctgggcgtggtggtgggtgcttgtagtcccagctacttgggaggctgaggcagagaattgcttgaacccgagaggcagaggttgcagtgagccgagatcacgccactgcactctagcctgggcgacagagcgagactctatctcaaaaaaaaaaaaaaaagaaaggagtcatacaatatataacttcctgatattaactttttttaactttgtgtaatacctttgatccatccaaattgttgcatgtatcaagtttgttcctttttattgatgaatagtattgtatgggatggatattccagttcgtttaaccattcatttgttgaaggacattttgattgtttccagttttcactattacaaatacacttgctatgaacaatcatgtaaatgttttcatctggacatacattttcattgttctgtggtaaatatctagaattatgactgctgggtcatatggtaaatgtatatttagtttatttttgtttgtttttaagaaactgccattttctccccccaaaaggattaatgtttaaccactgtattttagttattttagtacttactatatttggataaacagtatccatgatggctgtggtagggatagagacaggagatagcgggaggtccagcgaaactccaccttcaagcctagggcagcctgaagactgaaaaaccagactgcgggtaccagatgaagtctgtcacctcctaactgattctgaataatgcccacctgcgcactaggggaaggagctggagccaggagaagcttaaactgttttcagaggggaggagccaggcctctccagctcctgtgtggtggcctgggattcaatctgtgaggcaggagacctgccaacaggagtctctcactttgctgaaagttcctctttccttttttcttttcacctaataagcctgtcctactcaccctgcaatgtgtccgcatgcctaaattttctgggccatatgacaagaacctgtttttttctagaacagtagccagcttgcaatattttcaatatggtccccaatgatccctgcctcctcccaatattcacagccttgtgtaatcccctcccacatttttctaggtttagaatgtgtggtcaatagtttaaaacagaagtgatggtagacttccaagattaggttgtaaaagactgtggtttcatctctctctctctctttctctctgtctgtctctcttcatatggcctgaaggaagtcatgttggaaggaaccctataggcgagctcagttctaaagaactgaagccttctgcaaaaaccacatgagcaaacttgaaagtgaatcgttcagccccagttaagccttcagagactacaactctagcaaacacttcaactgtaaccttttaagagaccctaagccaaactcaactagctaagacactgccagattccttaagaagctaagttttgtgttatttgttactcaagcatacacagcaaatatatattttgacacaaaagtgcagtgatgccaaaataaaaacttaaaatgtaagagtggctttggaaccacctaatgaatggagctgaataaactctaaagattttgagaagactgctagtgatatcttaaagagccttttacacactgttcatagaattttgactttgatgaataactcctgggcagatacaggacagagtcctaatcaagaaacttccaaatttttcctgactgaatttaaaacttcctaggaacaaagactcctttgtaacttccattgttctcctttcttattagaaatacctatagtggttattcatatgcttgtcccaccttcgtatgttggttatgtgggaacagataacttatctcttgagtttacaggtctataaatcaagataaacgtactggagctttacctacagaactgcacccaagaaaacttatcataactggtcctgattcatatagtgaaattctagattatgagctgatgctgtaataggatgaggctttgtggggtatcgggggtgggtggcgaggggccttgggaaagggtgagtgtgttttcagtgtgggagggatatgaatcatcagcagatagaggaaaaactgtagcatccaggccccaaaatggctcccagtgattgctgaatcctggtttcacactcttctcatggtccctcctatattgtattaggatcagtctatgtgaccaatagaatatgactgaagtaatagtatagtgtgtcactgctgagattcagttatagaaaattgtggcttccgttttgttccctctctctctcatcatttgctttaaagaaagacatgatgtaagtagcccacatggtgaaaaactgaatcctcctcttaacagccacatgagaaaccttagagtcagatccctagtcccaattaagtcttttttttttcttttttgaaactgcacctctagccaacacctcgattgaaacctcatgagacaactgagataaaatcattcagctaagccactccagcattcttgatccacagaaacttttggataataaatgtcctattttcaagccactatgatttggggtaatttgttatgcagcaataggaaactactactgtgattaataagacttaagaataaaggctgggtgcagtggctcacacctgtaatcccaggactttgggaggctgaggcgggcggctcctttgaggtcaggagtttgagacaagcctggtcaacatggagaaacctcatctctactaaaatacaaaaattagctgggcatggtggtgcgcacctctaatcccagctgctcaggaggctgaggcaggagaatcacttgaacccgggaggcagaggttgcagtgagccgagatcacgccactgcactccagcctgggcaacagagtgagactcggtctcaaaaaataataataagaagaagaataaagatatccacaaacacagaaacatgggtaagatttatctgacacagaaataactggagtttttcccaaaaaatgtggttttaagcacagtttagatgctcagaattattgtttcagaaaggcataagtgaactgtgattataatttgtagaacatatctctaacatattgaagtgtatccttttgaaacaggaaattttctctgacttgtttactcagccggtagttctcaacccctgagagggtgcaggggctgggatgagtgcttctgggcgccagcaggggcagaactctgtgtggccccgtggcagagttttggagggtacctgcgacccctggagctgaagagggtgtgtgatacagtgtggtctgttagctttgctgtctacggacggcttaagtatttaacagctcattgtgacagccctctgtatttcgagctcttgttcagcatccaagaagaatcaggccgcacaaacgaattgaagacggtaaatgtgggggattttattgccgatggaagtggctctcagcaggatgggaagctggaaagggaggggagtgggaaggtggtcttcccctggagttcagggcagccaaactcttctccacagtcccaccatcaagccgtccctctgaagtcaagctgcttctcaccaacatcaagctgcttctcttctctccttctctgccacatgctgccagtggagcctgggatttttataggtacaggatggggggtgaggtgggccagagtggttttgaaaaagacaacattcaagccagaaaacagggatgtaaagttctcactttgggccgtgggtccaggcttgatggtagggccctcgccagggatcgcccgcttctacccagtatttccctgccctctgtccatatcacttttggaggaaaatagcaaacaaaagaagctgtaagtgtgtctcctatactattcaggagagcacatattctgaccaggtaatatgaattcatttggccagtgtctaatcttatcaaggattgcatagaactgatgacattaaataattacaccagctcatctggttgtgataccacattcacaaagacaccatctaattataacctggcttaactcataaattttcctagagaaggcccagttcactagctacctgttatttgtttctaagctagctggtatttgtgacctgtatcataaacaagcattctgatttttatgtaagtgatatgtggtcatgttagcagaagccagttacggtaactcagatcaattctggatgccctgcagaaaaaaataagcttcttaatttttaagtcaaaagagcatgggaactgcactgagatcttaacaactagtgctctttcctctgtcccttcaacagcagtgagctggcctcaattccatctctgattttactcactttaaattcaatactactattactaaatctcactgtgttacccattcaaccaaatataacttagtaatagttttcaggcaattgagaacatacttccatttaacaatgacaagaacaacaaaatgctagatgaatgaatgaatgataggtcagttaacttttagaagctgtagttaaaagcaagtattttgaatgtattaacaaggcaatgtaacatgctgggagcgggggaatctcatgtcatgtttagtgtgtgtatttgctacaatttgtcagtcaagtataattttacaaagaccttgtatttagaatcaaatcgcaatgcttggaagtaattgagttgcattttgggatttgccttaagggagatagaaggtgagaggcttctagcttaagtacaattacagaaaagggccttgcatttttatgacttaggttattggccaatcaatgggtcattggatctttattattttaattaaaattggttcactttgatgacataaaacatattgattatgggtattctcctcagagtcttgaaagatttggtagaaaatagcagtctctacctttctcatgtacccatcaattctgttaactctcttagtctgatttctcttttcttctttgattttacttctacatcactttttgtttttattcatattttgcagtaatcttatggaaatgacacccacccctacacagcgtataaccaggagtcattactactctgtatttgataagtgtagaaagggccattgctcatgcaaatgtctacacattctctgcatagctacttactattagcttcaatattgtttaactcaaacactgtaattttgaccatagacccaaaattattctgttattttctttttcactcatgtgtttatgcatttattaaaaaatatttcagtacttactgtgtattaagttgggaaggaaggaaagaagggagagaaagaagaaaataaagaaagagagaaagaaggaaagaaagaaggaaagaaaaagaaagaacgaaagaaagaaagaaagaaagaaaaagaaagaaagaaagaaagaaaagagaggaagagagtaaggaagggagggatggaggaaggaagggagggaggaaggaaagggaagggaagaagggagaagggggagagagaaaaaaatgaaagaaaaggaaaagaaaagaaaagagaaaaggaaagaaaagtaaagagaaagaaaagaaaggtaggcactaaaacgttgcaggtattcataaagcagctgcttaaaaataaaactaattcttttctataaggttattctcttctagacaaagttcaactggtcaaatactcttgttttttaaagttgctttgtaataattgtcctaagcttgttttatttatataatttagtgtatttagagtgtggatacttagatatttgggtttcaaagttcacgtgctcaaattatcatctaagctctaagatacaaaaaccaaaaacaaacaaacaaacagaaaaccttaacaaaatgtttataatttccttaagctgacctttaagaacatccctgaaatgcatcttttggacaatattttgtttgtaatgtttctggacattaggaaaagttaatatagacgagggaaaataagtaaggaataaaactctacatgtctaaagaataatgccaagcaggagaaaggaagtttagcatttttaaactacctaagtatgttaggtaatgggttacttatgaaaattaagtatttgtacatttgtacatttttatagcagcccttcagaccaaaacatgttattgaatttatattccttcagattttagaaaactaattcatgtgtttctttttctactacgttcatcgttcaaaggcaaaagttatgattattcacactaaataggatttttaaaagactatcaataacttcttatttgcacaagatttaccaccaaatgatttacaagattcgtttctatttttcagaggtatttgtttgttttgaattttgaaaatggtaataagcactgataagacatcataagaaaagtgaggtttacaagtataagttacccagcctgtcaattattggcttggtatacatgcccaagatcaccacattaatatttagtggtatgaccattaattttatgtatcaactttattgaccacagggtgccagataaaatattctttctggttgtgtctttcagcctgtttctggatgagattagcatttgaattggtggattcagttacgtagcttacccttcacaatgtggttgggcatcatccaagtctttaatggtctgagttgaacaaaaagcaacaaaaggctgggtgcagtggctcaagcctgtaatctcagcattttgggaggctgagatgggaggatcacttgagcccaggagttcaggactagcttgtgcaacacagtgaggccctgtctctaaaaaaataaaaataaataaaaatgtaaaaagcaagaaaggggaaattcactacagttttcctacctcactgtttgagctgaggcatctcatatcttctcagacactgggagtaggatttactccattgactcccctggttctcaggtcctcaaactccaactgatttacaccaccagctcccatgtaagccaatttctcttaataaatcttcatatatataaacaatctcctactggttctctttctctggagaactctgactaatacaagtaggaagcgttcaacaaagatttatccagtggagattcaaactaatgcctgacacattttatactccacgcttttccaccacaccaggtagtgccaatttatagaaaatactttctccagaaggcttggtatttagaaatgtcatataatattatattgcttgtcatggtaacaacgtgaaatacaagaatatgatactaaaatatttgctttaaggtagaaattttctcttacaatttttcctcctacaagaagggcgtagatgagtcagacactgatccaattctcactggcccagttaacttgtctaatgtaattgagaagatgaaatgaaggaattcatctatacattaactaataggcttccttaagtactaagaaatgtctactccaaaaggaaggatgtggctttcttaaaatacgaaccaaacatagaaatctcagaaggtcctttataagataacttatatagcaattaaatggcattatacactaaaattcatagtccttacagttttttgaaagcagtctcaatttagtttgtaactgtgattttctttattttctaagtccaatctcatttttttctttggttttcatttttaattgacacataataattctacatatttatgtcgtacaaaataatatttcaatacatatatacaaagcataatgatgaaatcagaataattatatttatgacctcaaaaatttatcatttctttgcgctaggaacatttaaaatcctttcttctagctatttgaaaatatacattgacttattcttaactatagtcaccccacaatgctatagaaccctataacctattcctcctttattgcatctagctgtaattttgtatccattaaccaacgtctctatcctttcctccctcctaccaatcccagcttctaataatcacagttttcacggtttacttctataaggtcaagtttttagctcccacatgagtgagaatatgtgatattaatctttctgtgctagacttattttgcataacataatcccctccagactcacccatgtttccaagaatgacaggatttcattcattttattcaaatatatatatatatatatatatatatatatatgaatgaatagtattccatcgtgtatatatactatattatctttatccattaatctggtgataagcaattaggctgattccatatcttgactatagagaatagtgttataataaatatggggatacatatatctttctgatacacttactttatttcctttgggtaaatatcaagtaatgggattgctggatcatatggtattcaaatttttaatttttggaggaaacattatactatttttcaaaatagatgtcctaatttacattctcatcaacagtgtataagagctcccttttctccacatcctcaccaacatttctgatttttttttaataacagccattctaattggggaaaaattatacctctctggatttaatttgcattcccctgatgattagtgatattgaacatttttaaatatacttattagccactcgtatgtcttattttgagaaatgtctattcagatattttgctcattttaaaaatgaggttatttggatattttgctgttgacttctttgagttcttaatattaatcccttgtcaaatgagtagtatgcaaatattttctcccattctacaggttacttcttcattcttcactctgttgtttcctttgctgcacaggagctctttagctttatataatccattggtctatttttgcttttatagcctatgtttttgaactcttaaccacaaaaactttgcccaggccaatatctctagttttcttctagtagtgttatagacttgggtcttacatttaagttttcacccattttgagttgatttctgtatatagtgagagatagagatctagtttcattcttccacctacagatatctaggtttgtcagcaccatttattgaaaaggctgccattttcccaatgcctattctttgcacttttgtgaaaaatcaattggctatacatacgtggatttatttctgggttctctattctgttccatttgtctatgtgtctgtttttatatcagtatcacactgctttgattactatagatttgtagtatattttggagacaagcagtattatgcctctagctttattcatttttctcagaactgatttagttatttgaggtctttcgtggttccatacaaattttaggattttttttcctttttttttttttgaagcatgtcctaagtttggatggaaattgcattaaacctgtaggctactttgggtagtatggtcatttttataatattaattcttccagtccatgaacatgggatgtctttccattttatttgtgtccactctaatgtatttcatcaatattttataattttcattgtagagaattttcaactccttggttgaatttattcttaggtatttttttattatttttacagctattataaacataattgctttcttaatttatttttcactaagtttattattggtgtatagagagactaattatttttgctcatttattgtgtatcctgcaaatttaccaaatttatcaggtctaagattttttttggtggagtctagattttcctatatataagatcatgtcatctccatatagggataatttgacttcctcttttttgagttggatatacttttttaaagagatagggtctcactgtgtagcccaggctggtttcaaactcctgagctcaagtgatcctctcattctagcctcctgagtagctgggactacacaaatatgccactgcacccagctgcactttattcctttctcttgcctaattattctggctaggacttccagtgctatgttaaataagagtggtgaaagtgggcatcattgtcctatcccagtttttcaaggaaaagctttcagttttctccattcagtatattagctgtggttttgtcatatgtggcctttactgtgttgaggtacacttctatacttaatttgttaagaggtgtttttttttttttcatgaggtaatgttgaattttatcaaatgctttttctgccactattgaggtgatcattcaattgttgctgtgatgtatcacatttattgacttgcatatgttaaactatccttgcattcctagaaaaataatcccacgtaattgcaatgtataatccttctgatatgctgttggatttcatttgttagttttttgttgaggatatttgcgtctatgttcattcaaaatattggtctgtagatttcttttattgttgtgtccttgtctggttttggtatcagggtaatgcttcccttataaaatgagtaagaaagtttgtactcctttttacttttttgcaaaattgtgagaactgattttagttctttaaaaatttggtagaatttagcagtgaagtcatctggtcctaggctttgtgctgttgttattgggagattttttatttctgatttaacatccttactcattattggtctggttagattttcaaattcttcctggttcagtcttcgaaggtggatgtatccaaaaatttattcatttcctctaggttttccaatttattggcatatagttgttcacaatattctcttgtgatcctttatatttccgtggtatctgttgtaatgcctgcattatgatttttgatttatgtgggtcatctctcttttttctttgtttgtctcactaacaactgttcaattttgattatctttccaaaacactatcattatattgtttttattttattgatcttttgtattttttgtgcctgttttgtttatttttgctctgaattttattatttctttctatctactaagttgggtttggtttgttcttgcttttctaatttctcagaatgcatcattaggttgtttatttgaaatctttcttttttgatgtgtttttgccataaatttctatattactactgcttttgctgtatctcacaggttttggtatgctgtctttcaattttcatttctttgaagaaatttcttcatgttcttcttaattttttattaactaattgaccattcaggggcacgttgtttgatttgaatgcatttgtacagtttctgaagttcctcttgttattaatttctatgtttatttcattgttattttttaaaaatacctcacatgacttcgattatttttaaatttattaggatttgttttgtgacctaactttgtgctgatgagaacaatgtgtacttgtagttgttgcatcaaatcttctctacttgtatattaggtctatttggtctatattgcagttgaagtttgatgtttctttgattttttgtctaaatctgtccactctctgttcaatgttgagagtgggttgctgaagtccccgactatttgtaatggagtatatttcttctattcgttctaatagtatttgcttcatatatctgtgtgctctggtgttgggtgcatatatacttataattgtgatatcttcttgctgaatttatttatcattatataataactttgtctcttttaatgttttttgacttaaagtattttatctgatataagtatagctacttctgctcatttttggtttccattcacaaggaataactttttccattctttgactttcagtctgcatgtgtatttccaggtaaagtgagcttcttgtatgcagcatatagttaggtcaattttttaaatctatatagcccagtcagcaaaacttttaatttgataatttaaaccatttaccaaagattttattgaatgttgagaatttactcctgttcttttgttaattgtttactggttgtgttgtaaaccctttgttttcttctctgcctcttattgtttaacattgcagtatggaggtattctgtagtgagatcattttacttctttctctttcttacttgtgcatctgctgtaccagtgagttttatacttttgtgttttttcataatggcagatatcatcctttcacatccacgtgtcaggctctcttatgcaattcacgtggggctggtctcgtggtgatgaattttcttagtttttgcttgtctaaaaaagatcctatttcttttttatttctgaaggatagctttcctgagtataatattctcgtctcacaggttttttttatttctttcaactctttgaatatatcatcctattctctcttggcctgtaaggtttctgctgagaaatcttctgttagtctgatagggatttccttgtatgtgacttgttgcttttcccttgctgtttttagattctccccttgtctttggacaatttcagtatagtttgcctcagagggcacctgtttgggttgaatttatttgtaatttttttagcttcttaatctggatatccatatctcttctaagacttaggacatttttagctattatttcattaaataggtttctgccttttagcatcttttctcttgctgtaacttctataatgtaactatgtatttgcttaataatgtctcttatatcctatagagtttcttcattctttttcattctgtttttcttttcttttctcctcttttttgtctcattgggtaatttctctattcaccttcagaaattttttttctgcttaattcagttctactattgaagtttttctattgtattttttatttcacttattgaatttttcaatttcaagatttcaggttggatctttttaaacaatatctatctctttgctaaatgtctctttcagatcataagctattattttttcttggattgtctatttgtgttctcatgtctcactgagtttacttaagatcattattttaaatttgggtctgttactggagaattatgatgttgctttgaaaatgccatgtttctttgctctttcatgtttttcctgttcttaaattgatatttaagatcttgtaggacagtcccttcttccaattttatgtaatagttttaatagggaaagactttttcctgtagatattttcaataatgtgggttggatagagtgctttggttaaggttctaggtgggcactgttgtatattatccatatgatttctaaagctgtaatcaatgtcatcagtgtctgagagtgcatcagcggtctaggctgcaattatttgtgaaatctgtggcagagctttactggggacagggatgccaggttggttggtccttggtctccaggagagcccacagaggtgcacagtcacgttgcctgtggaggggtcaagattgcctgtggcggtgacaggctcctcatgggacagtcctcaagtttatggagagcgtgcacagtcttgtgatggccccattttggatgaagcagggtccctgatggtgatggaaagccctgggcaggtggctcttggattctggggaatgagtgtgtcaggtcactatgtcctgagggctgccttcccagtgtgctggatcatttatgccctgatgtatagagctctgcctgggctctggtaacaaagttacagctgcaccactatgttcatcttttgtcatgatgctgcagctttcctggtagatgaggtggaaggtcagcaagccccagggatatggaggtgcaggggctattgggccccagggaagaataaactcaggtggtggctcttctctaaaaatggggccatgctgtggcagcttgggtctttggaggtgaagaggacccaatgtgaattttctttctgggacaatgcagttgcatggactccaggcagctctctatacttgactcagctcctgcaatggctgtgaagctctcctgttagtaggagtgtgagtattcatcgtgggaatgtggactactgaggatctcttgcttttcttttttctgcagtggaaagctcctcttggcttgcagacaatcctggccagacacttcattttctctatatgcatatatgatactatataaccctagtatctatgcctcagagggtttttgatatttcgtaatagaaaaaaaaatcataagatttactgaatcgtaaagtgcttttttttcctttgatgaagtcatttgaaatattctaatatctagcagttgtccctctgaaacatttcatggggaagggggaatccttccagaatatggaggtttaagattgtaacctgatccaagtggagcttgacttcttggctcctgattttgatgctgttttccctcattatacactaagatagctttatacaatgtaattagtggttttagtcagcacattcatttcagggtaaagggaaaacaaaataaaatatctgggaatgggtatatattttaaattaataaagttactttattttatcctccctctttactagagaagctaaatgcaaaactaaatagactagcaattattatccaattatccacagacatgtgtatgctttagctgtatttttaagaataccaacaatgagaaagctgacagtttcacaattagctgacaaacaaagcccccattctctctctactcctcctccttactctctgattttacaagatcaaattagtattactgaataaactatctcaatgctatactgctactgctaaggattaaattctgtttcaccatctaaacagaaatttaatttcccagtctaaacagaagatacagatccaagaatatctaatgaaatacaacccacagtgtgttctaattacatacagttgaggttttcagagttaatcctaaagagagtaataacttcccccaaaatcagacactgtccaatgccttgatttcagtctagttcgactttgagcaggaaccccagacaatatgcacctaaactatggacccacaaaatctatgagataataaatttatgttgttttaagctgataaatttgtggtaacttgctatacatctatagaaaactaatacagtttagttcaatattgtaaggatttcagttctcttaagttaatcaacagagtcaatgcaatgtacataaaaatcccaggacctttctgtgcaaattttaaaaataattttaaaatttaagtaatttaaaactaataaatttaaaatttaagtaaattaaaactaatacaattttgattcaatattttaaagatttcagttctcttcaagttagtcaatagattcaatgcaatgtacataaaaatcccaggacttttctgtgcaaatttaaaaaataattttaaaatttaagtagaaaagatccagaaatgaccaagttaatactgaataggaagaacaaaggaggaagatatatactgatactagtgcaaggacaaacattacatggaatttaaaaatatatccaggagcagaaatagtgtaacatttatacaatcacttgatttattacaaagttgaccttgaagtaaaaagagaaaagatgattgatttgataattgttactaggtctataggatatccacatggggaaaattgtatcttaacttttaccttctgcaacatctgtcaacaatcaatttcaggccaggcgcggtggctcacgcctgtaatcccagcattttgggaggccgaggcgggcggctcacgaggtcaggagatcgagaccatcctggctagcatggtgaaaccccatctctactaaaaaatacaacaaaaattagccgggcgtggtggtgtgcgcctgtagtcccagctactggggaggctgaggcaggagaatggcgtgaacccgggaggcggagcttgtagtgagccgagatcgcgccactgcactccagcctgggtgacagagcaagactccacctcaaaaaaaaaaaaaaaaaaaaaaaaaaaaaaaatttcaggtgtatgatacatttaaatatgaaaggaaaaacaataaagtttctacacagtatcttcatgaccttaaagtttagcaattatattttaagcaggacacaaaaatcactaaccataaagggaacatctaattgatgtactagttttattaaaataaaaattatttttctaaaataagctaccaagtgaacagtaagccacagagtagaagaagatattcacattacactcatcagaccaatgaataacatttagaatatgtaaaagtcttataaatcaattttaaaaatcagataacttatttatgagtgtcttaaataggtactttacaaaatagaaatttacatgatcaataaacacataaaatggttctcaacttccatatttatcaagaaaatgcatattacagtgctccagcactgcatatagactagaatagttaaaattaaaaggactgatatcattgagtgttggccaaaatgtggaccaacttaaaaagcaatactatttcacttctggtggattaaacatatatataaaactttggaacttgccgtatcttctaaagctaaatatgttatacttgatgatgatctaagaactcttctcccaggtggaattgaaaatgtacttaaatgtgtgttaaagcacatgtataagaatgttcatagcagcattattaataattgttaaaaacttagaatgcttttccagtaaggaaaatggatgaatctttactaaacaaaatgtcatagttgaatttcacaaactattttgaataaaataaacctgttgtaaaaatgtacatatgttctctgttccatttatataaaactaaaaaataacaggcaaaattaatttgtggtgatagggaaaaatgactcctttttaaaaggttaatgactgggtaggcacacaaagtatatttcttgtggtactgataatattcaacttcttaatccatgaatgctttcatgggtgttttcactttatataaagtcatttatattttttattttacacttctttttacatatgttacacttcaacaacatgtttaccaaataaataatccaaaaatatatatatttggtcataaatcaggtatggttcttcaacaagaatctgtctccccctactaaacagcaggactcctgtgctccttagagttgaagatacacacatacacacagacaaacacattcacatacagccaaacacacacatgcctggaaaatattgctggattcaagatatgtgtgtgaaggatgattgaacattgatctttgagaaacttttacggttgttatgcaccccacatacataatatatgatttgtagttgcgtgtctgatataaaagatctaatttttataaaattgtgttacaagtatttgattgagactgacaacatgaagtaggaaatccttaaatggtgacctacatccctaaggcaggtgaaaagtatcatgagaatcaactgttattttgcaaggtgtagtaactcaattttaaaatggcccccacagatcccttcctcttattatttacaactatgcaaaactcccttctcttgagtataggcttgaactattaacttgtttcttatgaacagaatgaagcaaaagtgagaggtatttccgagattaccttccaaaagactgtgactttaatctccttcacaggctctttctcactttctcatttgattcctgcaattgaagccatctgctatgctgtgtcctgttctttggatcagcacatatgacaaggaagtgaaagtagtctctgtccaacaatcagtctaacagcctgagaagaactgaattctgtcaatgaccacgtaagcttcgaagcagacctttcgcttgttgagccttcagatagacagcagccctagctgacatcttaactgcagtcttgtgacaggtcctcagacaggataagccaaattatacccagactgctgatccacagaaaatgagaggtaataaatatcgttgttttaaaccactaaatttggtagtaatgttacatagtaaaaaataagaagtatacaatatatcaaattgtgctgcttctttatttcatgctttaaaattttatttccaatttttagtttttaaaggtattatctatggtattaaaaataactataaatttattattaaatgtattttattatagttttattaatattctattacatataagatataataccaacttatggatttataaaattatttatcctgatatataaaataaattgacatataaaataattattttattaatcatcattgttatttaaaataaccacatataatcatagcctaattatatctcaaagctacctaatgccttctttaagtgactagtttcacattccaaagaagagtcaactaattttaagtatatttgtagaattttcgtggatagttctaagtagtttggtcacatatttagttaaattggaagcaagtaaataagaaaatagatccgccatgaacatatccgatattggagtgtgaaaggcaaatacccagatagttatgataaaaatgaacaaagctattaatctgacaattaatagggccagatttagcaagatttcagattatgttttattttaatgtccatttatcattgtctataagatccaaagaatgctcatatacattgaataaattgtccatctgtcctattttttaaggatgatttgactaaaaacattttttctcacgtctattttctcatagtagcacttttgacacatccatttcccatttttggttttggaaaatgaggtcactctacctatggaaaagacaaaggaaattttaagtctctccccttgggttgtttgtagtctcattgagaagaagacaaagatgtgtatctttatcttcccttaatacctgtaaattaggaaaagtaagaatggaaaaacaaaggaacaaacggagacaatgagatacagaaaagctcaaagaaagataagtcagaactaaacacaagttttcttatgaataaagtatctcttctttatttacttttatcttgtttcctagatcagttgtcttacagaattagaccaaccaattacaaaaatgacaagatacaaacatatagcaagcatacaaattctcaggaaagctacacttgaaactagttatgtggcaatgaaatagacagattgaatatattttgaagctgccacaattatctaaatatttagtaatatttaatctgtaagatattttggtaggtttccttgaggaagcacaatttcttctttttagagggaatgtcacctgtcagtttttataaaatatattgcatttgggaaatctaaagtcagaactatccataatttttaaggaaaatgtaaaatcatcaaatcagtagcaattttatattttgtttctgaaattgttttcccaccctcttcaactttatgataatttatcgggttttcagagaaaaaatacacaggagatacaaagaaaaaatatttttccaggtttatctttccaacatgcttttgttcatttaggatttgtttagctgttgattttgaaagtttattttttcatacatactagctgcatatagttgataaaagcctcaaatacagccaggcatggtggctcacacctacaatcccaacactttaggaggtcaaggagagaggacggtttgagcccaagagttcgagaccagcctaggcaatgtagtgaggccatgtctccactaaaaattaaaaaaaaaacttaaaaagattagctgggcatggtgatccacacctgtattcttagctactcaggaagctaaggcaagaggatcacttcagcccaggagttcaagcctgccatgagcttatgatcacaccactgcaacagagcaaggtcatgtctgaaaaactaatgatcataataataacccaaaaaaagaatatgaaatatctaaatctatatccacaattataaaaaaggaaagagattttatattcaaccactgaatatgtatatggaaggcaggatggcttcctctctacccaccaatagaaaagtaatgtacaatattagcaaaggtttgtgccttcccaattttcttatagcattctgtggcttgctacttgaaacatcaggggaattgttgtatttgaaagaaataaaatcataattgttaagatcaagcaatggctttacatgatgacgtgtatattttgttattcgatcctccttggcccgaaatgctgactatttaatacaagagatatttctaagcaatttgaagcatgattggcttcaacatttgctttgtacttttctcagaacaccaagtacataatagagttttgtgatttttttttttaaaaggggtgtgaatatgtagtattacaattgcaataatgacctacaatagtggtgattcagaagttgccttttagggctacgtaagactgagttccaaccataaaaatggcagcaaataaaccaatcatttaaaagtgtcttataaccatttttttcaaagtatcagtaatttacaaaattgcacagcacattagtcaagtcttgtattaactaaatttaaaattctaaataatcatacaaagtccatatcaatgctttgatacttgacattatggtacagtgggtttatcatttattacaatgagttattttcccaaattcttgcatctgtggtttcttctaagaaaataaatttattctatgcattttcaaatcaaatcatttgctataaatgataaattttttttctaaattgtcatagaaactatgcttatttcaacatataaaataatcaaattcatgctacttgaaggaaaagacaagtccatatttaaaagatagatttatctattaattaattacattttatttcaaatccaaaatataaagcaggttcaccctatagtttttgctttttattcttttaattggggaagcaaaagtgatgaaatttaaatatccaactcctgcttccttggatcttactgaggcggggagaggggtacatcaggttataaatattaaataactcaagtctgaaagaagggatctttaatgagcaggaacccactgtacaagctgaaggtgatagtaattattttataatgttatagtgtcatcttacagataagttttagacacgtttattttatgagaaatctagaatttcagtataatagttatttgaaattatcaggttgtcacaaaaaaaattattgtaaactcaaatttcttgtcttaccagattccagaaatagttgtatagacagccaataaaagatttgccttcataatatttgtgaaatacacagtaaaaatagcatgcgatgactaacttagagagcaataatgagggtatgggtggcagacttaaatgggagtaaaaacagattggagaataatttgtataatctgatcccattttggaatactaataaatgtccaaatatatatatatatataatttttttcaaatatcttcacagaaaacacttgaaatagttatctctgggtgataagactacaaatgattttattcttacatttttaaaatataatttctaatgtttcaattataaacatgcattactggataatttttaagaaaaataattgttttatgtgaccatgaagtaagcatcctttgttttccaatgtgaaaaatactgtcagtaataccttggtaagatgaatatggtttgtatttatgaggaggttatagttaatggagaatcaacaaagaaactctaatgccattcagtaaatgaaatgacaaatgaaatacagggttatatatgacagcatctatcagaagtatataatatggtccaagagttaagcaatggcaaaggaaaagaaataagaactataatatatttataagagtattggaaacatggtagttttcaataatcaattaatcaattaattacaattttattttataattaattgattaagtacatttaattagtcaattgattttacaaataattacattttattttaatgctaaaatataattaattaattaaatttaattacattttattttaattctaaaatataatgtatgctagtcttctgcttttattcttttaactttggagattgaaaaaagctaaggtatgattatgcccaatcttctgctccccagtctggggtatattacccttaaaatcagtgggtagactgttcacttttgcaatggactagtactacaattgtctttcgatagcctctttcagaaactgtgttgaaaaagcctaatagattaggcactctcaacaacaacaacatcaacaaaaacaaaagcactttatcatcattcagaaataaaatgaggctataattacaacactagcagcatttcacagtttactttgaaattatcctttgaggtggacatatttcatatatgttttacatggaacattttaagcatttcccttatgagtttcaggtggcattgatactggtttgttgtttttttcgtattctctttcaactatgcgcattgtttgggacaagacatgttgctgtggcatatgttactaggctacttaactgttaaattgggcatttttccttgacacaaaatcctatacattatctttgcccaatgtgtttagtttaaattcctctgcccactattctaaaaaaaagaaactataaacactaaagtagaaaactctggccaatttattttatctataccatatagatggatctacatggtatagatatctatggtatagatataataatctagagctatatagattaatctatatctatagttatagatatccataagtgttaacaaatacattgcctacattgtgtaacttatatttttgtatttttattataatggtaattgatatatcagcatattttagcatttatagctgcttagtaggaatgtgggctataattgccactttctacctttctattttcttaggaaactccaggattctaaaagtaaagccctatggaaataaatcaataacatttcaaatgaagaaccaaaatcgggaaatgcaaatcacaactctaacatcaacattaacttatgtaaacggctcatttgaaattatcacactttttttctgtttataaaacacagttatcttaaccttaagcattgtatcatccacatgttttcatctttgggcttctgaatatgtactagccggacaaaacaaataatagtctttataatacctacagatccctgtaagaaacaaatagcctactgggttaccagatgcgctatagtactacaaaattaaaggaacagactacaaaattaaaggaacagatgctctttgttaaccttttttctaacaaaaaataaataaagttttaaaaatagagattgggagcaaactcagaaacctcacatctctaaatattggaaagtttgaaaaacagggataactgaaaatgttgcttaaaaacatcaagctaaaaatgaagagaaaatctttgataacaaagaagagagacatcaagaaccaaaggatgaattttgagtaaataaatatattgaatgatgtaaacaaagaacagtggtaagagtaatctaagcaacctcaaaagttttttaagtaatggaaaaacattgtttagtattatataaaatttgtcaatgctgtgatttacaaaagaaaagaaaccgtttagtcaaggagaaaataacaagtttttaggaaatagaaatataaggatttcaaataaaaataaggacaaaaacaatgttttgcatgtagtgacccatggattgccttacacataagaatgagaaactcaggtagagaagaagaaaaatgagcccttcaaactcattcatactgaaccagaacaaccacaaacaaacaaaaccttaaatattaattgtcttcttaaaagggttaaaaaaaaacaaaataaatgctcatacacaattgggtaaatgtaaaactggcaaaattgagtaaggtcaatgaaatgtatcactgttgattttctgattgtgatattgtgctatagttatgccagatgttacagttgaatgatacacagtatgtttctatattttttctaacaactctttgtgaatctcaaagtaactcaaaatagaaagttaaaaaattaaggaaaataaaggttgaccttttcaatcatctcagctattgttccaattacaaagttaagtaaatcttacaaatttccttcaaatggtcttacaacatatctttgaggatattaagaccttaggagaatataatcggaaatcatttaaaatcagaaaactgagaaattgagaaataatcaaaagccattagattcacaaacacagtgagactattatgtgactgtggccagaaaagaacaattaaacatccccccacccccagcccccccacctcctcacgtgagctacttaactgggcaatgatatggctatagaaagaaaccatgaatttgaataccagaggttgccaaataaaacgaaaaggggtaagacctaaataattgtcttaaatattaacctaagcaaaaaacctatgtaaaatcaaattaaaatattaaaataacgttagaaaactccaaatacatgggaatactaaaaatctaatataaccaaatataaatctaagaccattccactcctaaaacaaaatacaggagaatactttcaaaaccttggagctgccagtttttctgttttaattattattatttttaatttaggacaagactgctatgatttgaatatctgtctcctccaaaactcaagttgaaatttaatccccaatgtggcagcagtaagaggtggggccttaagatgatgagtatgctcagcccccctgccatgtgattccctgtgccacttcagaactctgcagaaagccctcatctgcaagaagacccttaccagatgtggacctttgaccttggacttagcctccataactgtaaaaaataaatttcttttctttataaattacccagtttgaggtatcctgttacctgaaacaacagaaaatagattaatacaaagagagaaaaaaacagcattaaccgttaaaaataaaactaaactggatttcaccaaaatcagcttttcacttattaaaagacaccattaagaaaatggagaagcaagccactgacacagattggagacgaaaatgatatattgacagtacgcatattcagcaaaggactgctatcaagaacatacgaagaactgccaaaagtaaaaatatgaaaaattattgataaaaaaataagcaatgaaaaaatgctcaacatcctatatgaccaggaatatgcatattaaaaccataaggagatactattttacacttataagagtgagtaaaatcaaaaggactgataacactaaatgttgacatgtggaccagtcagaacccttatgtattgctcatgggagtgtaaaatcgtgcaaatattttggagaggagtttcttaaattaagcatatatttagccctcaccctggcaattcattactaacaataaaatttaagcaggagaaataaaaattcccttgaattccatgaaataatatgtgtaagtaggtacatagcattgttattcataatagtccataaaatgagaaaagtctaaacatcctttaatagaagaatggataaatattcttgaggcatgttaatacaattgaacagtgtaaacttaaaataaaattctaagccccctaactgatagaatggatctccctttcagccaatgatgttctaaagtaaatgtgaaaaactagttcaggccatcatgggaaggaggggtcagacatatctcattatgccctcctccctttggaattcaggcacaattgatcagtgttaacattaaaaaagagatcttaagactgaccaaacagactctttgtggcaatcagatacatcacaaaatgacatataccaggccctgtaagaaattgaagtattttaccctgaaatatatttcttcgatatatctttaaacagccctgtaaagctgcctcttgtggggaaaatcaacattctgtagagaattctcttccctttccaggtcttttcctgatccaggagagattagctaagtctggtacctttttaagtctgataacaaacatttgccctctattctatctgaagcctgctacctggaaacttcatatgcataataagaaatttggtctcccaaaccccttatcttaacccagacattcctttttttctattgattctaggtctttagataaattctttcaaccaattgccgaacagaaaatacttgaatccatctatgatctggaagccccggctttgagttgtcctgcctctcaggaccaaaccaatgtacatcttacatgtattgattgatgttttacatctccctaaaatgtataaaaccaagttatagtctgaccaccttgggtacatgttttcagagtctcctgaggctgagtcatgatcgtgtccttaaccttggcaaaataaacttgtaaattgattgagactcgctcccttgaagggaagaacccagtaaccacctgttgaccaaagagcccttgggtcctgaataaccagcagcaatacccaggtagtatgccatggaccttgggtgagactttgagacatgctggcttcaggtactagctcagtcacagtggattaaagcaccaagtgtgctctcgaggtccccaatacaagcctacactcttggacagcatttctggacctgccctggaccagaggggagcccactgccctaaagggtgagtcccagaccttgtagcatttaccacaagctgactaaagagcccttgggtcttaaatgaacattggcagtggcctggcagaactctccacaagctgatggtggtgatggacctggggagaggctcctctgcctatggaaagaggtagggaagaatgggaaggactttgtcttgtggtttgagtgccagcttagccacagtagaatagaacatcaggtagatttctaacgttttttacttcaatccctggcttccagacagcatctccatctgggcctgcgcagaactttccacccggaagggaaggacataaacatggctgcctttgccactggctgactgtagagccctaggtccttgagggaacataggcagtagccaggtagtagttacagtgggctttgagcaagacccagtgctgtgctgatttcaggtctagcctagggcagttccagtgatgtggccacagtggggccctgtgtcatcccacttccagctccaagtggctcagctcagagagaaacaacatttgagagaaagtaagaaaagagaaaaacaatctgcctggtaattcggagaattcttctggatcttatccaagacaacaaaggcggcacatttatgaggctgcaataaccctagtgtaactgggcttagggtccccgttaaagcagatacagcttaaatcacaatgtcgaagtcatttttaatatctgaaaagccttcccaagaaagatgggtacacacaaggcagactgtgaagactaaaacaaatacctaactcttaaatgcccagctacagatgaacatttacaagcattgagaccagccaagaaaacttcaccaaacacagtaaataagacaccagagaccaatcctggagaaagagagatatgtgaccttttgttacgggatctttggggtgttgcttttctggcctgaaacctctgcctggtggcgcctttgcccaagttttgcttgggcgcactgggctcattcttcccaccctgcctggcaggctgtgctcagctcacgctaccagcctagatcccatgcctgccaagggtgagtcagcaatagagcaatgaggggtgggtgagtgagtgtggggtccggccactgctcagtcagacatgccagctgctgcagtggggcagacagctacaggtgctggctctctgcaaggcatagttgaaccaggcacactgcaagcagcttccctggctggccctggaagcacattggtgcccagaagctcagagacacaaggaactacagaaacccaaagagggagtcacagccctgactctgggagctcccaggtctgggatccctgaggggccacagctcttcttctcttctcctgcaacatggcaaacaagggacatgtttcagccctgtttgtgttagctcttttagttctgccattcagtggctcccaagttcttgtcctgcaacaggaggaaatgaggtaggcagacaagtggagggtaagcaagatgaaggggaattttattgagcaatataacagctcacagaagtcccacagagggtagctcctttctgcaggcagggtatcctgatgagtgttcagctccgagcacagaagagaccaaggagtgggaagctcctctccaggcaggtcatgccatcattttgtacctctcagcaaagagaaggccctggagtgggttgctgttctctacagctgatagtcctgacttctctgcaagtttctgaagctctcagcaaagaggaggccataaagtgggcagctcctctcaggttctggtcatactgacatctcccactctcagcagagaaggtaactactctctgcagctggtcatcccattgtctgctcacctctggctgagactttggcttttatgggcctcaaatgggaggaagtgtgcactgatttggctcatgggcaaccattggtgggcccagaaaaggcaccacaagttcccactctagtctgtgggactggcagcccaggccccagctttcaggccctctatggcccaaaggtggggcctcaccagggatgtacccccttccacccagcaatctgtccacctcctgctgtcattcatggtgcctgggcttggccctgactttcctccaagatcagagtgggcaccacactgagagcagggaaaagccaggcagcaggagcaggcacttctgatcctgagagggcaggggggccttcctgggaccccaagagtgcagggatgtctaagtctgcagccatgatttgggcagccacaactgcgcccagggttggggggtggggctcctgctggctccatggagctggaggttggagtctgcagccacagtttggctggctgcagcagtaccctgggagctcctgccccatcttgcaagggccagggctcctgcttgtccccagctcccagctgctccatggagaatgcagccctggccatgcctccttgctgcagctggcatgatggcaacagcaggcaatctggagcagccactgccattactttcagaaaattaaaaatagctattttgagaaagttcaatgaatttcaagatgatagagaaggaatccagaattctatcagatgattttaacagagactgaaattaaaaaaaaaagcagaaattctagagttgaaaaaatgcaattgacatactgaacaatgcatcatagtctcctaatagcagaattgatcaagcagaagaattagtgagttttgggatgggagcagtggctcatgtctgcaatcccagcactttgggaggccaaggcaggtggatcacgaggtcaagagatcaagaccatcctggctaacacggtgaaaccccgtctctactaaaaaacacaaaaaattagccagatgtagtggtgggtgcctgtagtcccagttactcgggaggctgaagcaggagaatcacttgaacccgggaggaggttgcagtgagccaagactgtgccagtgcactccagcctggtgacacagcaagactccatctcaaaaaaaaaaaaaaaaaaaaaattactgagcttgaagataggctgtttgaaaatacacaaccagaggagataaatgaaaaaaatgtattaaaaattgaagcatacctattaggcctagaaagtagcctccaaaggccaaatctaagagttatcgagctaaaagaagaagtagagaatggaaggaactttgtcttgtggtttgagtgccagcttagccacagtaaaatagaacatgtggtagatttctaagggttttgactctaatccctggttcacagctagcattgctggacctgcctggggtttaggggaatttgctatcctgaagagaaggacacaaacatgactggcttcactactttctataggattagaaagttaattcaaaaggataatttcagagaacttccaaaatctacgatatcaatatttaagtacaatagggttatagaacaccatgcagctgcaactgaaagtggaatacctcaacacatttaataatcaaactcccaaaggttgaaaataaaaaaaggatcataaatgcagcaagagaaaagaaataaataacatataagagagctacattacatctggcagcaggcttttcagtggaaaccttatgggcagggcaaagtggcatgacatatttaaagtgttgaaggaaaaaatcttttaccctacaatagtattactggtgaaaatatcctcaagcctaaaggagaaataaatactttcacagacaaacaaaagctgaggaatttcatcaacaccagacccatcctgcaagaaattctacagggagttcttcaatctaaaaggaaaggacattaatgagcaataagaaatcatcttaagatacaaaactcaccagtaatagtaagcacacagaaaaacacagaatattataacactgtaatttgagggtataaactcctattttatgtattaggtaatagaaaaactcaatgatgaaccaatcaaaaataataaaggattacatcttttcaagacatagtacaagaatacataaaaacataaaaagttaaaaggcagtgagataaagtgtagcatttctattagtttttttctcatttgtttgtttatgccatcaactttaagttgtcattagtttaaaataatagattataagatagtatttgcatgcttcatagtaacctcaaatcaaaatatacaacagatacacaaaacataaaaagcaataaattcatcacaccactaatgaaaattgccttcactaaaaggaagacaggaaggaagaaaagaagaaagagaaaatcataaaaaaaaaacagaaaaaaaatagcaggagtaagtccttatttatcaataataacattacatgtaaatggattaaactctccaataaaaaagacatggagtagaagaatagattttaaaaaacccacaatgatctgttgcctataaaaaacatacttcccctataaagataaacacagacagaaataagaaataaaaaaagatacttcatgccaatggaaaccaaaaaaaagagtaagagttgctatacttatatgagacaaagtagacttcaagatgaaaactgtaagaagaaacaaagaaagtgattatataatgataaagaggtcaattcagcaagaggatatagcaattgtaagtttatatgtaccaaacactggagcactgagatataaattgcaaatattcttagccctaaagagagagacagacctcaatacaataatagctggacacttcaacacctcacttttagtattggacagatcttccaggcagaaaatcaacaaagaaaactggaggactcacattatctgatttcaaattatattaacactacaaagctatagtaaccaaaatagcaaggtgctggcattaaaacagacacatagaccaatggaacataatagagaacccagaaacaaatccataaaactatagtgaactcattttcaagaaagttgccaagaatatacactggggaaaagacagtctcttcaataaatggtgctgagaaaactgtatctctacatgcagaagaataaaactagacccctatctctcaccatatacaaaaatctaagactagaaactataaaactactaaaagaaaacatcggggaaactctccagaacatgagtgtgggcaaagatttcttgagtagtaccctacaagcacaagaaaccaaagcaaaaaagaacaaatgagatcagatcaagttaaaaaatcttctgcacagcaaagaaactatccacaaagtgaagagacaaccacagaatgcgataaaatatttgcaaactacccccctgagaaaggattaataaccagaatatataagtagctcaaacaactctataggaaaaaatctaatcatctgatcaaaaagtgggcaaaagatctgaataaacatttctcaaaagaagacatacaaatgtcaatggcaaacaggaatatgaaaaggtgctgaacatcatcaatcatcagagaactgcaaatcaaaactataatgagataacatctcaccccagttaaaatggcttttatctaaaagacaagcaataacaaatgctaatgaggatgtggagaaaagggaacttttgtacactgttggtggggatgtaaattagtacaaccaccatgaaaaatagtttggagtttcctcaaacctcaaaatactaaaaataaggcggagcttgcagtgagccgagatagcaccactgcactccagcttgggggacagagcgagactccatctcaaaacaaacaaagaaacaaacaaacaaaaactaaaaatagaactaacatacaatccagcaatcccactgcaaggtatatacccaaaggaatggaaatcaggatgttaaagtgttaacttcactttatagtaggcagcattatttatagtaggcaagatttggaagcaacttcagtgtccatcatcaaatgagtggataaagaaaatgtagtacatatacacaatggagtactattcagtcataaaaatgaataagatcctgtcatttgcaacaacatggatggaactgggaggtcattatgttaagtgaaatgagtcagaaatagaaagaaatgagtcaggaatagaaagataaacttcacatgttctcacttatttatgagagctaaaaattaaatcaattgaattcgtggagatagagggtagaagaatagttaccagaagctgggaagggtagttggggacttagggggaagtgaggatagttaatgggtacaaaaaatagaaagaatgagtgaataagacctagtatttgatagcatgacagagtaactataatcaataataatgtacttgtccattttaaaataactacaagagtacacaatttgtttatgacaccaaggataaatgcttgagaaggcagatatcccatttactatgatgtggttattaggcattacatgcctatatcaaagtatctcatgtgccctatatataatcacacctactatgtactctctacaattaaaaataataatttttttgaacggcaggagcaaaatttcttatagcatctggatacactgcagctatagtaaccttgttgttttatcattatcagtggtgtcttttgctacccaattcaatattctatagctactcaactactctttgtctatgcttctattgtttcttctcttgacatgacaaatgcttctggaattaatttatgcttcttcctagctttttctgtctaataatgtcaccgtactactgctttttctctatcttttagcttctgtacttctcaaatattactgctatttatatgtggccattttctagagggtaacatagaccatcaaaggatctgattgaattgactagttaccatatgaagtggagaatgttagtactgtatgttctatacctctcatattgccctgccttgtagaccattgattattccagatgattgactgaatgagaggtgattcctgctccaataatccctggctctgcttgcagaaccacatggaactaaacacagtgatccatgcaccaggaacctcttagaaggaaactgaaaatgtcatgcacatagaggctctccagaaagagtattgtagtaagcagccatcttgtgtggcctgccctaaaacattcatttattagtgtctcttccatggacatctcttttcttacactgatcagtctttgtattcatgaagcaataccaaatgattaagattatacctttgaaattaaaaaaaaaaatctgatacttgacaatgcctctcatattcttttactttctgatttttcttagacgtttggtgattttgctttgttaggatggaattttagtcattttatcagtttccaaaaattcccccttgaaaattagattggagttacatttttataagttattcatggctaaattggcatcaaaatattgaatatttctaccaaggcaattatagtagagtaaaatccactgagccaacctcttgtaatccagaaattccaatatttccacaagaccaaattgaaacataatagaaaatatcaatagtaatatggctcatataataatattacagctatataataaatgtttcatggtatttcattatatcaaaatatttttagaatataagaagtgctaattactctatttaacatgatagctcagaaattagaaatatcaacattgttcaaataataagataataactattaagtatttaatttgtgccagggttccaagagcttaacttgcattggagcatttaatcctcagtgggagatttatcatccccattttgcaaatgaggaaacacttacagagagtttaagcaacttgcctaacataatacaactactaagtggtggaaccaggatttaaactccaggcagtttgatctagagaccatactcttaaccattattaagatcagtctatgaaatatgaaaaccatcaatttaatctcacagagtcacttctttgagacatatgtcaagttttaatatatattaagggcaactttgaaaagaaggcagtgttgatgagagtaaaaaagacaatgatatatatattatttacattgcccaaatgtttctatgatggttaaacaaagtatcagatacagccttttagcttgacaacgtatgttttgttttctttttctttttttcttttagctgactcttgctcctctcaggaagagaacatattttcaagtttatttgcctaggcatcaaatgtttaaatattttagtcaatttctaattaaaataattacttttaatcaacattttcttatatttctttctcatttttaatttcagagccagacaattatgcatttctttagtcaacaactagctgctaattatttactatgtgtcaagtcttataatgctgaagtgaagaaaagagatttaaagtcatggatgtggtttcctttggaccttaaattctagcacaaaatatgataaacattgtaatcaatgctatcatgtacaggtatgtggtgttatgtgaatatatgggaatacctaattcgtaaactgggtttagaaaattcttgcagaagaaagtggcatccaaacaaagaaccaagaacgaataaaaattattatagataaagtgaagcgggtctagtggaatgacaaaattactgagtgtcaagaggtggaaggacttggtgaataatttgaaaaggaaccatcggaggatgatggccacatttctggctccagccatcaggtaaatattaacattcctttaaatctgcatttttgttttaaatcgttttcatatttattatctttatttaatctgagaacaactttttgggagatagagaggtatgcattttctagctgaaaatacaaactgtttacataatttgcctaaagtctcagttgaagagggtaagggagggtagttagtggattgcacacagaatgaagttgttttcaccataatttctactcatttagaacatactttttattctgctgtctaaagagcaacatgtcttctttcagacaagattattatctggattcaaatcaatgatacatttttccctttgtcatctgatgtagacatttctaactggctctcctgacaggagcaatccatcatcatagctggtggaacaattttgatcaactatgtcaacacccctatcattaccaccaagtgcaaatgcacattaatattctatgtaatggccaagcagatgcagaaagacaatacatctcttcaaaaggctcctgcaggcctcttctttgttttctcaccctccctctttttttcaagctttgatcatatgttctaattagatctcaaggttcattttactataccacaagcttctgtatggccactggaatccttctaactccatttacctacactatccaattataaacttagatggaagttaaacagcctgtgagaactcagaaggatatctcattgaaatggtagaagagttcactgctgtatctcagtagcaggcaggcacctcaaactggttaaactgtgtgcaccacagtactggtgctatgaaggtttctttcacaatagttttgcattttttaggtgttcaagatatgtctttgtggtgtatgcatgtgtgtttctgtgtgtgtgcacgttgtgtgtctgtgtgtttcttttgctttttggatgggtgggaagttaataagtgtcatgaattattaaaaaggaacttgaccttatagtgattccaacagaaaggaacaaaatctggagatatcagagagtcccttgtgcatattccagggactatgcgggcaactatctctgatggttgcaagaggaaaaaagaaggatttcagcatagatgacaaattatcactcaaatgatgatagtctgtggttataggccttgcctcccacttggattttggtattacccactaaaagtgctcatcttggaagaggatgtggagcctcagatgccttctctgctttccctatatggtccaggaaagcctattccctgagacttttctcaacaatcttacctcccaagacagacaacactactaaatacactccctgaaggatgaaggcatcttgttcgaggaaaattacctagtgaccatcaagcaggccatccagaggcaaaactccttatctgaggaatttagaagtaatttgacttccctattatcaaaagcatgcatctggtaccaagctcttttcccaaaactttgtaagtaactagaatttctatagatctctggaatgtatgcatattgaaactcattgtgcaacccttgctgacatcaaggcaccaaaatatctataaatgtaatcattcctcatgacctacatggctaatacggttcaaaatacccttaagctcccactttaaagtccataaaaacccctaaggaaaatccaccgcttcacactcagtcctcccttgctgaggtgcctcgctgtactcttctgcagcatgctttctatctaataaaaccttccttttcaaacctatactgttgtcaataaattcttcttgccaacctgagagtcaaccactttctgatgctggggctctgacaccctgccgggcatctttttgactcatcctgggactttactgggatttctcccttcttttttctctctgcttccctcaacagtctggtactttactcttagaaaccaatgatctttggctgaggccactcttcagtgggatcctgaagccctagagaaggagtgtctgtctgtctctgcccttggggccgagaaactggccagggttcttttccatttttgaattaccagtgaaccagcttaagtactctttggcaattgagggtttctggctgagtgcactccttggtattatccaaaggccaagacaaaaaagcaaatttactattgcccccttccaagggtggcaagtccaccttcactttaacactgtaaaccgtgccttggaaatgagcagcagcaaaatcaactctgcacagacacaatctgctggttgtggaccccattttgaattgaactttgtcacagacatcacatcgcaagtcacggacaagttctccttcacattaggtttgagctgatcactcaaacaagggcaggcctagactgctcatccaggcaagggtaggccctctatccatggtaggcacccccagatagagtgagcaaagggaaaagggaggtcaaaatccctcgcaggcacttcaggaatcttatagtgccgtatctaaacccaacatgggttcaactcattcttcagttctatcctatttgcccttgggttgcattcttataaagtggtcccattttgacccacaaactctttaaacttttatattcagagaccccatatgttcaggtcttttgggctttatctgatacgtaaaattacataaaaattgcataatcttccaaagaacttcttctctacccgattctgatgtcttagatgatccttccatttgcctctcacactctcctcatcctgctcccactttacctacaccctttccatctgcttcatcccccaatcatcaccctctccccataaacagatactttatcctcctcatatacttgcacaggagttacataagccactagtacagagtcctcagaaaacctccaaaatgttttccttgtccataaggtggcaaatgaagatttgggaaaaattcgaattcatgcacatttccaatattggatcttttgcaaattccatcccagttgcgttcatttagccaggagcactctaagttaattcaagaatttcaggccttaactatttcctttgttttaacgtggcaagatatatttgtggtattaactagttgatgttcccgcgaagaaaaatcttgcctttagtttgagcttaggtggatgaaactcatgctcgtaatcctaatgataatatagccagggaagaagctgtccctgacacagaacccaactggcaacaccaggccaccaatgttggcccagacagaggcaggggcaggtgagattatataataacttgtttgttggaaggaatgaaaaagaccgtaagaaaacctgttaatttttctaaattatgagaagtcagttaggagccatctgagaatcctgcccttttacaagctagactgctggacactatgcaaaaatatgcaaatttagacccccaaagccctgcaggccaatccattctggctgtacactttctaagtcaggcatccaaagacgtcagacaaaaactccaaaaattagaggaagacccacaaactccttttcctactttattaaatgcagcctttccagttttcaataattggaaggaaatatcaaaaataaaaaaggtgcttggggcgcggtggctcatgcctgtaatcccagcactttgggaggccgaggcgggtggataacctgagtttgggagttcgagaccagcctggccaacatggagaaaccccgtctctactaaaaaatacaaaaattagccggtcatggtggcacatgcctgtaatcccagctactcaggaggctgaggcaggagaattgcttgaacccgggaggcagaggttgtagtgagctgaaattgtgccatagcattccagcctgggcaacaagagtgagacattgtctcaaaaaaaaaaagcgtaaattggaggagaaaaaatgccgtcgccaactaattacatggcgacagcactggcacattctttttcattaactaataaacccagggctcatccctatgctactaacagaatggggacctgttattgctgcagaaatccaggacactagagtagaaaaggttcctaacctccaggttacaagccaaccctggaagcctgtcctcactagaaataagagggtcatcggaagagcgagtgaccctctctccctcatgaggtggggcacctcttccttctgggctgtcacagctacagccttatcaatctacctaacaagggagtcctgcagaatggggacgagggcaatgccaaggacaagctcttctaactctattcctggattataatcaagcctctgaaattcatcctctagatgactgatggggccttgaggccatccagcccctatcttttccatctctatggataagtctagagtaaatctgattgtggctaaacaagagataatgttcttcatagatacaggggccagttattcatctttaaacatttactatggcccaatgtgccagtcctccatttttctcacaggtattgatggaaaaccccaaggaggctgttttacactgccactcccttgtaaaatggaaggctattcctttcctcattccttttagtcgtgccaagctgccttgttccattattaggccatgacttaacacaaaattacatgctaatttacaacgaagccctcaccttccagctgtattaactcacacttcactaaaagagcaactgcagtctacagaaactcaaactctaaaacaagtgccatttgaagttggaatacttctcttcctggtcaatcaatatcagctgctcttgtattcattcagcttcagattcccaataagttcttcagactccctgatgcctcttgaaaccagaagcatgaaaagagttacagcccctaataacaaaatttttaacccatggattattgcacccatgcaactgaccttgcaactctcattttagctgtaaaggaatcagatggctcctatcagctagcacaaaccttagaattattaatgaagctgttattctgattcatcctattgtcccaaacacttataccctttttggacagactctctccaccacagcttagtttactgtacttgatcttaaggatgactttttctgcattcctgtacaatcagatagccaatttttgtttgcttttgaatggcaaataacttaacttgaacaattctgccccagggaatggcaaaacacttaacttgaacaattctgccccagggaatcagagatagcctccaccttttcggacaggccctagctagaaacctgtctaccctgcagcttctccaagacagcaatctactcccttatgtggatgaccctactaatctgtagtcctaacaaggctgttttagacaaaaatacagtgttagtatcaaacaaacttgctgactgtggatacaaagtatctccttctaaggtacaaatattcacagaaagcgttcacttttggggccttattttaacccttggtacaaagagcctctctagcgctcctgaagatcttatcttaaacatgacaactccaggaactaaacaacagcttctgtcctttttgggtatggctgtgttttacagaatatgtattccttcctttggattaaaaggaaaacctttatatgaagccctccagggaagtgaggaacaacctctatcgtggactaataatgtgaagcatgctctaaacactttaaaaacaggctgtaatctcagtcccagccttagccctacctgatctgactaagcctttctttttttacgtacacaaatgaagggggatagttttgagagtgagcctaagatctatggccctctaagcaccccacagcatatttttcaaaagctttagacctagtatcctaggaatccctccccacctcccagcttaagagccttagcagtggtagccctcttagtctaagaaaccttaaaaatatattaaccctcctgggatcttatggctttgcttcactgctaattaccccctagctaaaaaaggagtctgtgcgttcatcaataaaacatgttccacttctcttttctgtacaggaatgcggaaaaagagaagtgaaaactaatgtccaaaaaaattttcaaacaagccacatggctatacacactttcctaaagtaaccactactgggccaaaacctctactgattggtttctaaaaatcacatggcttctcctattacttggacctttattccttgttactcttcttttaatctttggtctctgcctttttaatgctctcattaagtttatatcatccaggttacgattccacctacagatgactatgcaatcccaatatcggcctgcaacagcaacttccatttacatggggcctcttaatggaatcgtttcttctccccatgaacaagtttttcatgatcctcattcccttcatgacaacagagagaaaaggaaaaatacaacttatccactcactatcccctttcagcaggaagtaaccagacagacctggggcccctcttcactgtgctattttctgtttcttgagactgtaataggcagcaggtagacatgagcatgggggaacacaaagggtcaaagatttgaccaagatattttcaggaagaaaataaggagaggaaagatcacctggagactatcaagcaggccatccagaggcaaaacttcttatctgaggaatttagaagtaattcaacctccctattatcaaaagtacataacttcaccctgcactcttcaactactcagtgattcccacacctcagtctacttcaaaccctagatacctagctccagattctttagagaagaggatttgaggtttcctctcatctcctcctgtggctatcttaagattattaaacactttctctgctgcaatctccagtgcctcactatattgactattacataactgactgcaaagcatgtctgtatttgtgtaaaatattatcagaattgtgggaaaatagacaagttctatgatagagtctatttctaacccatgttgactccaagtctctatattgggcccacctgcaaaatcagagtgtaaacgaaagagttgagctgcaattagaaaccttaatgaaaagcaacttttcaggctttgcttttttccttggctattgttggggcttaggaactgataccccaaaatacatgcttcgatatgcagaactgaagaaacctcaaggtctctctgacctctcacttccccattgtctctcccaaagcacaggatgagttgttgcctgaagtccctttatctgcctaaagtactgatccaccaggagaacaactgtttattcttctccttactattatctcattatctattacagaaaagaaggccaaaaatgtaaccacacttgaatagaccctttcacaagataatgtctgtctctcaggctcattcaaattccatggagaaatatcttaaagttaatcatctctgccctccaatccattcattctccctagttgtcatttattgcctgtcaacagaattcctcttttcctccctcctataacctgttttgccaagacctaagttcccattctttctgtacccacaaaagatgatatataagcttctaaaccctatttgggggataggtaatcactccgtgattctcactgtgtacacattaataaatctgtatgccctttctccaattaatttgccatttgtcagttgatttttcagtaaaccttcagaggacaaaagggaagttttccctttggtccctacactattaattcctatgtcttacctactcaaatttcttcaagctttaaacagagtcaaagcaggaaaaagcagaacaggtaaatgacaggaagtttctacttacagaacacttgtaaaagtgtatgcaatgtcctataaaccatcatttttttcttaatcgtatctttataattggatttaattatattttcaaaattttaaggatagctcatatatattgaaattaatctctcacacttccatattcagaaactctagatctgacatagagatcatttcaccttcctgattaatataggcagtacgtggtgcacaatgaagacagactttgcggccaagacaaaagtacctgagtcttcaccctgttggaacagtgtatatcagagtgactttgggagagtaattttaagttatttgttttctttcctatccataaaatggttttccaagtcccttcctcaagggttgctttaaggtaaaatgagagaatgtatgtgaagttcctgtcaggtagtgatctctcaacaaaacttccttccctcaggctagatttcattattagcagctcaagggtataacttttacctttacttgatcttctcagcttctgttgggaattttattttaaactgaagggcattttctctttgcttcacttcttaagtaaattcagtacatttaaattatttcccttgatcttcctacctcatcttcttttacagagaaactaatttgaccttccctccaagctacttgtcacttgtctctttttctagtccttatgttatattcctattcttagccaatgatttcaaatgcaattctttaagtaatatttttcaaattgcctttaattaataaaatatgttgtattaaacacattgtattacaattgtatttaattaatataacgtgttttgcttgtctttctgttagtatgaacttatggttgaaggcattctcaggggttaacaagaattctggacagaaatatggctataagtaagtattaatcaggctgcactttgacccacttccttgtaactgaaagtcactagatcctgaatatttgtatccccattcccactgttcttatagatagaatctctgacatcagaatcataaggcttttctttaagaattgcttaaagatgttcttcggatccccaattccagtgaaacagctgatgacaaccattttgaagacccccacagaggaacagaatcaacatgagatggtttcttcctctccccatcctatgacttccccctgtactcttccaccaattaacaatctccacactttgacccactccaaaacccttaaaaacccagccccaaactacctggggagatggatttgaggttccttcccatcttctccttcgatggcccaaccattaaacctctttctctgctgtaacctcgtgtctcagcatattgactttttgcacatattgggcaaaaaaaacctattatggttacttgattgtgataacatcaaaagtacactgaatttggagtcaggagacctgaattctaatcctagctttgacattaattagctacgtggatataggtaactcacttcacttctgaaggcctcaaagccctccaaggattttgagataggcaatttttccctcaacttagcattatcatttcatggttttatgatgcaacttttacagcatcacaatgttccattaataaaattatattggtttttccatatttttaaatctaaaccttcaaataactatttgttttcatttttttctggtgtgttgcctttgtctttcccctttattctttcatgttttgcttacctaaggaaaagcttacaagaaggagctgtgtcaacagtagttggtatggatccacactaacttttatttggggttttaactaagagaacttaatgtatgacttattgtaaaattataaaaatcaaatcaagttttataacaacagccatagaatggtctttttttttgcaaaaccaaagatacatatacataaatgaatatgatttatgtagaaaatgatattaaaggatacatacaaaattattgagaagcaattagccctggaagagaaaaatctgagctagaggggtagtgaggctaaaatttgtactataaactgtcctatattatttaatttggtataacaagagtgtattattcttataataggaatattactttaaacatttttattaactgatatttattttatgtatataaggttttttttcaatgtggctttgtaatctaccacatactggacttaaagttataaacaggagagatgactgaagtggaggaaggttcattagcctcacacaggaaatgccttgaagtagaccgtgggtgaatctgtttaagctgtgacccaagcagaaatactttcttctcaaagtgatttgaaactattattctcattgaatctatgataagaaaactaattatgataacagacatacggttggaagaggaaacacaggtagagctgtctttacattagagaaagaactgagagagctaggcaaaagccatcattgggggtaacagaacacagcagggggaagcattctgcagagcatattggaacaaagcaagtctctccaaaaaaatctaaagaaaatattttcagaaagtgcacaaggcaaagactaatggctccctgcagatattcataaggatataagaaagaagaggctttccaagaaaatataacatatttcaacaacaacaaaagactgggctagatttgagacacactaagagtcattaacaactagaagttcttatcataacactatctatactgtttacaattgtgtcactttatgcttatataaagtataaagagaccactttacagaatatgggttcagtcattgtcagggtatcagagtatcttttgttttcctttattatattgtaaggacaacataaagtaacccaaagagaaaggagagaacagcttaacctctctaaacactgcacattttggaagtctaatcccctctccctgtcccaaatcctctcattatatctaagcccagtggaagtatgctggtcctcacaggctggcagttttctcaacctgcaattagagtgtttagctctttttgccagctacagctttagtcatcaattccaggaaaccctgacaccaattcactgaatatctaaacatacattacctacttgatcatctatattcccagatgcaatgaacatattttcttgttatctttttaagtcttctaagttatattgtgcacaatttaaatacacttgccttagtttctgagacagccgtttctcggttttctatctttcccagttatttcttgccaatctcctttgttagctcctcctcttcaacatgaattctaaatgtgtttgcttctatatcatattttctgctctaatataccctgtctatatgttattacatcctaagaaaaaaacaattcctatcataggtcaaacttatgctctaaattccaaaatcatatacccaatggctgatataatataactatgaaatgagcaaattcaatatctaaaggccactaaattggaatgagacttctacccgaaacagattcctccaagtcttccttaaatccataagttactttcacacacacacaatgccccaaaacaagaaaccccaaagccacatttgtttcccaatttccttcaatcccacattcattcccagcaatttcagtcaattttacctctaaaatatgttttgaatttgtttacctcttctgcaattctctagtgcattactaatataaatacaatgcaagcaacatatgtaatttttaacttgctagtagtcatattaaaaataatttgtgtaagtcaaagtgataatattttggatatatttggttaaaatatattattgacattaatttgacatgtaaaatataaatatatttgagatattttatatcatttttccttgataaatgttcaaaatttgttgtgtgtcgtacatttacatggcacatctcatttcacatagccgaagttcaagtgcttgataagtcacatgtaactactatatcggacagtgcagctctagtatatggcaacattacctgttgcctggagaaatacaacagactcatatctggtatcctcacatctattcttgcccatcctccatttccaataacatacttcctatggattggtgagaactgaaaacgacataatcctctgtcccacagggacaggaactgggcagaccttcctgctcctgtgttaataatactaagagcaagcaaaacaatacttagctgctttctccaggaaatacctgctcctagaagagaaaactgaaacagttaaactgaccaattatcaagactagtaagctcattaagatttactaccaaaccttcaattcattttgtccactcatccaaatctacttatcaccacaatccaaccagttctctctcttgcaagatacactttaaaatcactcagcacaggctttaaaatgcttctctaattttcccaccttgagttatccacatattggccaacaaacctattatggttacttggttgtgataacaccaaaagtacactgaatttggagtcaggagacctgaattctaatcccagctttgacattaattagctacatggatgtaggtaactcacttcaaggtggtattctcctttatcacactaagtcttagtggtagtactgcttgattaacatacttttggaaagtcaacattcaacaaaatcaagaggaaacttcttaaaatgcaaattggatcatgcccctcccctgttaaagctattacaatagttatcaatgctttggaacaaaattcaaacagcctagcatgtatgaaaatgtcaaaataacttattgtctgtcttcctttctaaactcttaccactctactcctccattcagtaacttttagaaacagtgcctccttcctgttctttaggtataacaagcaattccaaattttagcatctttgcaattactcttctctgcctgaaacattccttcagtgttttaaaattgctgccacactcttatccttactaactaactaaaattcgatctcctcagagtgtaaaagactgctttgactgaaagtgatttatctcttaggccaattttcttttcatcatatcatcctgcttccttcctatcactcatcataactactttatccatatctttctttactccctgtctctttctacaaaaatgtaaactccatgaaaatggaaatcttatctgtcttatctatctccatatggctaagtgttcgatagatttattggcccgtagtacgtactcaataaaacaacaaaataagtgaataaaaagacaataaatggataaaagaaaaagaaagaaaggaaggagggagagagggagggagggaggaaaagaagggaaaagagagagaggaagggggggagagaaagagagggaggaaggaaggaaggaaggaaagaaggaaggaaggaaagaaggaaggaaggaaagaaggaaggaaggaaggggctctgaaaacgtgccataagtaaggcaagtgtgataatcccctcccttgtatattagaacaccatgtaacaatgcatcaaagggagaaacccaggactccagagctactataacacgtagctgagaccaggatcaaggtcttctgatttctaatcctgtgctcaccacagcctaacacactgtctttcagccttctctgattgatgtggttcttttgaagctaaatgtaaggcttcagatttaataaataaggcatttgaaggagaaaattattctctatgcattaattggtgagttcatatgtttttgcatttacatctcctacttgcattttgattagcaattacttctgtcaatttaacaccaacattttccgtaatcagagacatgttataccttggaacagactcaatgagtccctgaaactggtgagacagcacttcaatcccttcaccttggctgctctagtagtgaacatgcctgactaccagtctgatttcctaaatctcctctgagattttagatggttagaaatacttttgacatatgcttggcttcagctcattgcaaatacaaaaacgcttgttccaaatacaagcctcatttttttctattattattgttagtatcattattagtattacctgtatcactcttctgaagtcacttttaaagagattccatatcctgagaaagagaaatccctgaaaattacatttgatcagtaaatttagtgaggcataaatggtataattagtatttgattgaaatttctatcctcctttagtagtaaatatattgtaagagattgtttgtcatctattcgataatttcttatcccttctctcttgcttaaagaatctcaatttttaaatattaggcggcttaaggcaggtgactgaggaactgaaagggatgactatgctgccatcccaaccatacaggatgaattttgaacactctatactaagcctagtaattccgttcctctcgccatttagcaaggtcatgtttctttgacatgcatgaagactcttaaaaattttaactctgcttatgtttctactcctcctccacctgtacactggcgtccaggtacccttcacctaattgtagttctttctcctgtcttgacctccgtatccttgcaaatgtgctgagccataattccaactatccaactcttgactcattcatcaaagcccaactggaatgtcaacaaatggctacatctttgcataattttctccatggcagaatttaaagtctctgtattttaaaacatgattccatgtgcttccattatattacttatcacaatgtattcctgtcatttgcttatgtacctctttattctatgagaatgccaattacttgatagcaaagatcatgactcaaccatgtttgcgttcttaaaacctagcacagtgattaaaagatagaaaatactcagccatttttcaagtgattgactgtatcctgtacaggatagaaaattacttctcaatatgatgtcttcttcattgtatgtttcccatgttcatgataatctcacattccacataccctcctcaagacttttttctgttttatactttctagctattattatttcaaagggttttatttagaagagggtatcaaaaagattatgtatagcttaatatcttaaattggcagcagctatatttataaaagacattaaagtatggcaatttaatattctattcactaaaatatttgactaattatacctctaaatctttacctgtcattaaacaaatgattatctgaagtgatttaagactctttggattggtttattttactaattaataagcaaaagactgtttaaattgacttatggtcacataattgttaaaaaataactgttattgttgaaaatgatgatgatgatgatgataataatgatgatgatgactatgataataagagcacgatgacagaagtgggtcactttgtattttctaaagatggatacaatattattcctcatctcacatgctccttttgacctttacactctttccattgaaagatggggttcgtgtctcctctcctttgaatccgggaggcttttaacttgcttgtaaccaagactatgacagaagtgacactctatgatttccaaagttaggatacaaaaggcaatatggcgtgtgctttgttaactgtaacttattcttggatccctgaaatgtcacacaaaaagcccgactatccagtggctaccatgctgtgagaaagccaagccccataagaggctaaatgtcaccttcctcagtcttctactccttagtccagatgtcagacatgcacaagaaggagtctgtaccctttctaaattcctgacccatagaatgtgagagcatgatacattgatggttgttttataccattatgtgtggagtaatttgttatgcagcaataataactggaacaaagagtgtgacaaggaatgtttatgtgttcatcagtcctatttcttcttaggcacagaggaagagggcattcaccagctcctttgcagtttattcaggtccttttgatggattttgtccaatgagatgtagaggaaagtacattgcattgaggtctggccaccaaacttcctattcaattatctactctctctcccatttctgcagtgacatggaggccagcttatacagatggcaaaatcacaagattgaaagatactgaatcattgagtcactaccttgtagagacctattcaggaaaacaggctggcatcagaccaacgtaaggttgataaataaaccatcattgcaataagctactgagatctgggggttgtattacagcaagtagtatttgttattctaactactacaaaaactaatactcactaagcagttacaatgccctagaaattttactaaatggcttgcatacattaacccttttaaactctgatgaaccatccttacgtaggtatctttgttatccccattttacaaatgcaaatctgaagttaaaagactacatgacttacatagggttacaaagatattccaaagaatgggaatttccttgaagacggaggcaaacctaaaataagtttgtactctaagagttaaataagcaaaatccactggaagagattagctatttgtaaatgcattgtcaatgtgagtttttggtaaatgggagtcgtgaatttaatcccaaaccattaattttagagacaaaagaagatatataaaaatccctggttttattttaattttatattttttagtaaacagaccactatggaattgttaaaatgtattttacagccatttttaaggttacaaataatttttgttatgggatctttctatattttatgactttaattaaatttctgatttctgttccaaacattgcaatataagacagtataaaacacactttaatcattaaatttatagataattttgtgactttttagagcttataacaccaagggactgataatagaggataatgtgcataaaatacactccggcacattccacaaactctatccttaggatctttttttcccataacccagccactaatacatacactaagaaagtctcatccgggctgttctacaattgccatcatctttaaagagtaatcttgtcacctgaactaggtgaaatgaagaacttttaaaacaaccacacggatccgactttgcagaagcttctacgaagacaaatagcatcaaacagacatgtactgtgcattcataattacattagtggccacaaaatacaatgcttagtacacatccttggaactcttaaaaccatcttaaataagagatcaagcaaatttaattctttgtgaaaatatatctcaaggtagtttctactgtccttaatttttgtagtataaaatttaacaaagtaacatcgcatgttcttgtccttaattccttggggtctaatgattacattttgaacaaatgtccaatttggaaaccaaatcaaccactttatttaatgcagaacactataacattttttgggggggggggcagggtctcactttgtcacccaggctgcagtgcagtggcagaaactgtagcctcgatcccccagggtcaagccatcctcctgcctcagccccacaagtagatgggagtataggcatgcaccaccatgcccggataatttttctgttttttacagagacgggggtttcaccatgttgcccaggcttgtctcaaactcctgagctcaaccattccacctgcctcagccttccaaagtgctgggattatagatataagccactgtacccagacagactttgttttaaaggtctgaatcttccttatttcatatagcctacattcttttgtgggaacaaagaaaacagataaataaatgaataaatatgtaatacgtcaatcatcatgacaaacgctacgcaagcataaaattgagcaagaagatgaagagtagctgcggtgggagatgctatttttagatgtggctctatataggatctgtgtagggtgttggataaggcaaggatgaagctgacctgaagaggcctcctgtgcagagtcttggaagagagcatcacagttagagagcacagtaagtggacagatgccagaagcatgggcctgtctgaggaattaggggaacagccagcaggccaatgtgtctgaatctcagggagcagggaagagtagtagtaggataagtgctctttaacaaattgcccaaaaagtgattcttgagatttatgtgtttataactgttccatcaacaaagggaagtctatggagtctaaaggctcccatggtataaaaacattgagctgttgtattctcctatggtaagagaaaatgttcttcaggcattcaggtgcctgaagaccctgaatctcttgctgtgactttccctaccagtataggacctcaagtgcctctattcacttagagaacttttgctatcagactccagaatatttttcccgttgaaactccattatttagtttacagatactggagttataaaattcccagtctccctccattagctacatcaaagtctgttttctaaaattcatcattttataagttgtattcccatattattttctccagaaggctgattcaactctccaaaagttgtttttgaaatgtagatatgcagagaaactttatgtttgaagaggttagcattccttaagagtttttaggataaaaacaagtttttgtaccaaaataataaaacttactagattgaatacttaatataaatctaacttatttaatacttatacaagtttataatagtatgacatttaataattcacttaacaaaaagcaaaccaaaaactctaagattctgcaagtaaccgtcttccccatattacccttccattcacaatgttagccatttcccctgaacacctggagatgttttcaaagggagatgcttggctccttatattcagctactttgagtcaaaagctctgagctgcacttgtgtagagctctctgagtgcaggactagactgcatcaaagtcctattggaccatggactcccctgccagtccagtggtgttgaccctttggtgaaagagcacttcccagaacgacttcaagctgaacatctttctctcagaatgagcaactgagatcactaactagcgcggcttttgtagcttaacacgtttcctgaatatctttttcttactctagtcacctctgctcccttagtcaaaagtttcttcaaatgggatacacaagaggagggccattaaatgtgctgagagcataagacttcttgctgaccagtgccagcaggcgttccaaggtttccctaccttatactctgttttcagaagaagcagcaagagtactgttacagacttctttccactaaggtttgatttaaatttgcatataaaactaaggttactttgctattggccttttacgaagttcccttaggaatccccctggtaggtggtttctttacaaactggtcctgacactagaaaagagtcatattacttccagaagggacaaagtgttttaactggcattccatgagtcctgtgaggttgaagagcagagtaacttagatgaacttaggaaatctgcctaacactgaaaaatgaaaagctatgaagtctttgtacattaaataaattggaaatggtgcctgaataaattctccacagtcaacaaagtatcagaaaagcatgaaggggagaagcgcacatttgatagccgttaggactatggagagaaagtgttccctggggttagaaaaactggcttgacagggaactatgatcattagtgccaagcaccgggaactgtcgccctgtgggtggagacaatgcaccacagggcctcaagcagtaccatcaggacccagaaactagtgagcttaccaatttattctccaaattgggcacttaaaaggcagtataatccagtactgtcctgtgcaagccaagccatacatatatatactcatcctgtcactatattttaaactcacttagcatatacttattttatgtaaactcatttgtaatcccaataatcttcagacacaattaatactacactgcccccaacccccttatccacaggggttatgttctaatacctccagtgaatgccagaaacctcggatagtaatgaatctgattgccatcagtccgaacacatttccatttctgtcttccacccacaaatttaatgccttttccatcttaactaagcacttatcataccctgtggctgtgacttttgagtctgaagagtgatagcaaaactaataccagtttctttttccttctttacaaccctacagatagaagattcattcttactgtagatcttagtaaccttggcatatgattttttttctttccttaataagtcaagaactttcaccttttcacttaaaggaagcactttacagcttctttggcatatcaggattgcctgcatcactacgtgcactttggggtcatcatgaagtaaaataagggttacttgaacacaagaactgcaatactatatgactaatgggaggggagcacagacaacatggatctgatggacaaagggatgatttacatcccaggcaggacagaatggaacagcatgaggtttcatcacactactcagaagagtgcacgatttaaaacttataaattgtttaactctggaatttcttatttaatattatcagacagtggttgaccacagataagtgaaaccatgaaaatcaaaaccatgaataaggggatgtctacttctctataacatgaaacaacaacaacaaaatgacatgacagaatacagctgatgaatttcaacattctataaaccttaaaaattgagtttcaaaacataccataatcaaaggcgaggctaaaatttaattttacgtgttgaacaaataatgcaaaaatatcaaaaggaatgtaaaaactcccttgcaacctttggagaagggtgggttctggtaattaaacaactttatttgaaaagcatcagggcatgaatataaaatttggaaattaaaacaaaaaaacaagagtttgatccagaaaagaaagggtgagaaaaagagtacctggatgaatggcaagccatgagggtgaaaagaagagtagaggagggtggagagtacagcctgggaccctagactgtgaatagaaagggttagcagaagtcattctaggtggtcgtgtagctccaggaacctcgaagaaaagacaattctaatattcaaatatttgggatgattagatgtataaaggaaaactaataaaaaggtgagtggattcttggaaaagccaggcaggattttcgtaaaggctaaaacaaaatctctaaggcaaggttagtaaactttttctgtaaagggtcaggtagtaaatattttaagctttgtgagccattatagtctcctcataactcctcaaccttgccattgtagcacagagtcatagatataaaccaatggctgagtcacgtttcaatatgatttatggacagtaaaattagaattttataccattttcatgagtcacaatatcatattcttcttttgaattttttcaaccatttaaaaacattaaaaccattcttaggccacaggccatacaaaacatatagtggatcaaacgtgacccaaaggccaaaatatgccacctgctgatctaaaatagtaaataatgattcacatatatgagaaataaaaaataaaagagaacctccatacattagaaatgtttggcaaacagtcacttataaagtagaaaggtattattaattttataatatttgagatatcagcatttttaatagtccatgcaagtttttctaattagccctaatttgtaatttggtatgattttatctatttaaaattagctattttctgaggtgttggctatggagttgattattttttaatgaactttattaatatctaatttacatgcaactttaaatgcagtttgatgagttttggcaaacgtatcctccaatgtaaccacctcaaatgatcggttttcataaaagagtctgctgagaatttaagacagtgataaatcaatctgtaagtcaatctgggaataactgacatcttaatattgaatctccaacttcaggaatatgatcaatcccttcagatatttaggtgtttttaatttttttaatgttgtattataattttcagagtatagatattatatttgttttgttaaaattattaccgcttattttataattttggatgctgtgatatagtctactttataaataatattttctaattgttagttgctactacattgaaatacatattttgagtttcattgtatcattgtatttctctattgtccatgtcttatttaatttgcattttttttccttctttttggagatggaattttgctctgtcacccagtctggagtgcaatggcatgatctcagctcactgcaacctctgcctcccaggttcaagcaattctcctgcctcaacctcctgagaaactgggactacaggcacgcaccatcatgcccagctaattttttgtattttagtagagatgaggcttcatcatgttggccaggctgttcttgaactcctgagctcaggcaatccgcccaccttggcctcccaaacaggcgtgagccactgaacttggccctaatttgcatttgaagcatggacagtctcatttttttcatcatcttgggaaacactgttcagtcctttacttttacatacaatgatacttaaaagtagaaattcagtagtgttcttccattttcccctgcagggaagaaactgatgacatcatgtaaagtaaaaatataaatggtaacatgtacagctgagacttgaactcaggtcttctgattttacacaatattctttcattattggaccatttccaaacttaattccagagaattgtaattggataagataacattctacattggttagtgactatctgaaactgtaaaagtctttccctttagcagtttgagtatgaaacttcaaatagccagaagctcagcctggaagacacataaagaaaagatgtctacaaggccaccaagaaaaaaaaaatgttaaggaagaaaatgacagaaatttatagaagttgtgacactgcaggtaatctcaattgagaaagttatatttaattccaggaaaagccataaatctgttcattcctgtaggtgaaatagaatcagacccaaagattggattgttatataagctgatattttatattggactgtgtcccaattctagaagccatgtaaatgattcatgtaaaaacaattaatgtaaactgggccatgtaaatttatcttatttttctttgtttcctcaaaaattaaccttcatcaagtcagatatgcaaaatatgttcctattccctgatatatagagttagaaaactgacacagaaaatgcaaacttgagttatggacctgaaaatctacacacttggctttggaaagtatctctatatttttgaagcgcctttgataaggcacatatgaaaattcacaaacaaaacatgtgaaatctacattctgaatgcccgttataggaaaaattttacctgaatcttgtttctttttgtgaggatacttcactgcgggccacttatactaccctctctctcaattcaattatgtactcttttaaaatttcctccatttgtggttaaatgtcttttaccaaaaaaagatgaacattgagagttcagttctcatttatgttttaaggggtctataaaaattatgtgcagaattataatactaccttaaattaatataggttcaaaagcataatttgcatttaacagtctatcatttagatacctgatgttaataagcataagtatcctcttatttaaacattgccttataaaagaagagatttcttgatttaggactttgcccttcatgttgctctacaagcatgcttatgtagttaatattcgtcaagatatgcaaaaatattaattagcttcagtaggtctagtaagtactaactctatgtggtaataatagtagtagtagctatcttcttattatagcctattgtttattaagcatttcatttctattaactcatgtaagcataataatcttttgaagtaggtttaataccatgtctatcttacaaaggatgaaattgaggctaagtaagatttgtttcttgctttagttttaaccattatattatgcactcttaatagttgtataatttacacatgtatattaaatatcaaacagatcaaaatatttaatactgcttattctctgagtgtgctaagtatgatagtctataacctcacttgtctacacactgagtccagtggaaatagcaatactaaatgtcacagtatttagtgacattctaaatatcttagaattttaaacaactgctagcataattattgatcaaaacaaatagtaaagacataatcatatttttataaaaccctataaaatgccaagttctgatcttgagttagtattttattgtttcaaaggcactgaagagtattcataaaaatttagacataaaatgggattctgatacacttacaaatatcctcaatagcatagcctatccctccctgagcttgtataattacacatttattgctttaatgttgacactttttagataccttgaagaaaggatcaaatactttgcagttctaaggccagaatattggccaacattaaatttgaccttgtaaaaagaagattataccagatcaagtttattctcttctgtgaaaaagggacagtctttaagaaaaaaacggatagattttcatttacttgcacctaagtgagaatttatttttatgctataacccagttagcgattaagtccataagtttatggatcattttccaaggaatccctgtagaagtcgtgtagaggttcccctagaggctgcttagggaactgggggtatagagatagagacgatgaccctctgggtattcctccctggtttcaagtacagcagctctgattttatttgctttatctttttgaccataaagtgtacttaaagaaataatatatctgccttaaaactcagaaaacactctttcaaaccatgtacttagagacatgttctcagttgcatggaacatcagatactaaaggttcttaacactaatgctcttaactgaatctctctagcagtgattacagtcagataaaggaccaatataatttaatgttttattagttatttagttgaagaagctaagactctacatttcatgtttctgattgatactaacttgataaattcaacaaccaaaccagaaaacaatctgataaatcatatgaagaatcatatacagtgtaataggattaggacttaaaaacaagaacagaacaaatcaaaataaaggatgcatacataggcatacaagataaaaaaaaggaaaaggaagtcaacctctatccaataaatataatgtttaaatggaaaaaaatataggctaatagcagttggctatattggtagaaataacataagaacaagtcttctaatttatttgacattggacaggcactaatttgaatgtattcttgatagtctcttttgagaagtttgttgaaaattaaataaagactagtgaagaacacaaaatactaaatttttcttatgagaaaaagttaacagaaatggaagtatttatcttgaaaaagagatgactatgggagaaaattactgctctcaaaggctattaataattacaataaattgttctcctgccctacagaggaccactgtatatgaggaatatgtaaaaataatggcaagataatttgatttgctataagtaagctatcttgataatgaggaaatgtaaaaatactggaacatctaactgggagaagctataagatgtttttttccatccctagatagctttagtaagaagaaaaatgcattccgtaccctggttcccctgtgctatctcactggtttatattctcaaatatccactcaggaatagtgaaaatggagaggtttcactctggcaagactatatcctgaagttcatgtgccttctttacacttttaatgtttcttttatggattcatctacctctcagctttgggttattactagtccactaatccacagaggtaaggcctaaaaattttgcaacaagaaaattggtaaagtttcttgctgcccagacatagtcattggtacagggccacattttctaatcacttagaaatagttgtaggttgctcacaagtatttatcctgaggtttctctttgatatggtaattggtttgctttcaggttttcccaagcctcagtgtactagattctttgtcttgacacctttagactttgtcttacaagctcttccacagcatcctgctgccctgccagactccgtaatatttattggcccttttctttacaaggtccacaaatgacttatggactgctcagtatagccagtgacattcaggcctatcagatattaatactactgatgctccactcatatattctcagcacttctatatccatcttacagacttactaacagttaagtccagaggcttaaaaattgaattctattcatacttaaaaattatattcaccagtcccactgaatcttcctacagcaagcacctgctaccctgcctgagaattactttctttggccacaaaagcttgattggccctgaacatgaggttcaggtgacacctctgagggtagcttttcacccaggatgaataggtggctaaatatccagtttgttcatgtcaggtaagataattctgaagtgctgaggtgcattctgcagtactacccagagtttaacagcaggatcaagccccaagccccagttgcctgcagtgacccataattacaccttcttggttttcttcccctctctgcctcactttgtctcactttctcttaaatagactattgataacacaaatccttacttcagagtctgtcttcaggtgaatccacttaaggtatctccatatctttacatatgcattttccaaagaatgtgcattttttggtaacatttaaaagaacattttacattaataattgagggaaaacaatcctggtttctgtatatacagtgtgcctgcaacaaattgtgctctcacgcctgggaaggtggaatatatgtccccaaacagacaactcccagactgggacccttgaagtgtttgttgttgccagcaactccaagtgagatttcttgcagaacactctgtgattttatgatctaggatgagagggtttggccataaaataccacgttttcctatcaattccactacagtgataagaaagattctttcctttttgttcaacaaaaataaaaaagcaaattactttatgtatttttctttggcttctgatcatgctaagagacacctcaacaaatcctgcacccaacaaatcctatcttttctgcacacgcagcagtaaaatgcactcatttgtgtaagttataaccaaatacataagtaaaagtgttgtttgtgacagtagatctgactttggggatacatatgaacttctaaagttttaatagatttcagcattgacattacagcatagaaataaagcatttcttgcagtcatcccaggcattccagatggtgaagaacattgcaataattcaatggaaggaaaagcaaacttacccgaatcatcatgactgaacatctgatatcatgaattgtatcatagatcttctttgagatgtccacaaattgattatcatccaacacattcaatgagcttttgcttaaggcttccaaggcaacattcacttgtgttacaaattcaggaattactgttaaaataaagaataaggagaagattgtcctctttgtatttttggatttatacagtagtttccaggaaatgtagaatttggttttaaacaaatatttgattaatagatctttaattgtattttttaaatatagagatacacaaattttagcaggattatcttgaatctctgaaaagtaaaacgaatcaaagacaattaaaggcattttttttttctaaaccccaggcttctggagagaaaggcattattatataaatgttttaaaagattatctttctcctttatatcatctttgtttttacaaaaccttgggaccatacaatcatttctcatcctattcaatataaaccacaagacattacaaaaaggaattggtgtgtaaaacagttggaattgtaaacacaaagatatttaaagaaagaaagcaattgagttgctaaacagaagaaaatttagctaaaagtagtaattctgccttatagaaataataaaaatattgtaaacttccttttagtaagatgttttctctataataaaaaaaattagtgaaaaggaattggcattctcatatgaaaactatctttaaaataacaaaacactgactgactatagggatgcttctatcagtaagccaatccatggattatctttttaaattaaggcttcaaaatagtttcaaataaaaacgcttcttcaattttacttttaaggttaatgatattaacagttattatctcttcactaggctcaaggtacttttctaagtgttcaatgtgattcaaatcttaaccccagtattaactgagtattaatagtttaacaactaggacacagagaaatcaagactcttccacagattcattctgttaatgtgtaattagagatgtgaactcagagtcccaaaatgcagtttttgggactttacactttacactcaaactaatctactatatcatagtgaggaagcctcttgcccatatgaagatgtcgggtaaaaagattaatttttagaagaaataattataaacctggaagatagaaatattttgactggtataaaaatatcaataaatgttatttttctacatttaagttgtatctgcttgtatggcataccatctcttgcaattctgcctgccatgttattgatatgaggaaattttgatgatatacatgggcactctttttatctggtcctttctttcctctagctgccaaaatgtatcacttataccctacttctgagccaccatatctgctgacattatccactgtgctcctattctctgtctattctctaggcacattgtctaataaaaggtggctactagctgcatatagctattaaaaattaaattcattagcctcaaattttaaattcaattccttagtcatactcatcccatttcaactgcttaacacatacatgtgactagtgattaccattttgaagagtggatatatggctatcatcagggtaacttttgggataacagaaacttctattgggtcataccactttgcactgagaaaccttcaaatcacagtctccctttcagcggacggaataataaagcaagagggagagcaaactcataccactttgcctaggagaaacaatctcaaaccacaattctcttatatatggatgtgactctcaaagtatatctctaatctagacctttctccttaatttcagaactgtatatccaactgacaatggcaaaattctgcctgaatcttttataacatctcaaacatattctatctaaatctaaatacatttctttctacccaggaaacctaattttcctttaccatattctatgttggtgctgagtcattcatgaaaaaaacccaggtgttttatctgacctcctatacttctttattccttacatccaaatacctactaagtgccatctgctctactatgtaaatatatcccaaatccattgagaatttttagccccactgtctctattcatcatcatctactatttccatccacagcatagttcttcccatgtctaaattctgctcattctcaggttcattttaagtataatcttatgaatggcacctgctcttagcattaagtattatagtatctctcaaatgatggacactcaataagttgttttatgaacacatcatgttaatacagtgtttacaagttttcaattgttccttgaagcttttctttgtttatatcctaagtgcataggttggcatgcagtaaataaatgatcgaatgaattaagtgattaaatgaatgaatgaattaattaattaatatgtaaaatcaagcaaagagtaggtacaatgaaacatgtccagcttgcatttaaatgtgattttggttttgttaacaactgaaaagctccaaaaatatatttatgcaggcttataggaacattcaaatctgcttaatgagttaatcattacttttgtagtgttaaaagaggagggaacatctaagaaaatgtgtccagttatttcacatttccttcaggttctggagtagacagcaaaccaaccgtcaaaactactactctaaagaacaggacaaaatggcttctagcctctgtgatatgctctattcactccaaagacatagttaagtaaaaagagatatgtcctcaaaacctgtagggacctgtcggctacataactttattcatagtcatccccactaaaaaatgctttttctcatataccaaacaagtgtgcaatacagtaataatttaattctgtctattaatactttcaatctgctattattgatacagttcccaccatcttcctatgtagattttggcaaaaaaagaaaaatttaaagtcatgtaaagatctgtttttcactgccctgtgaagtaactgcaagaaagatttaaggaatcttacaaaaaaatacaacacagccttttcattagtgcaaaatgatttcattttaactcctctaagggccttttactaataaattaatattagcttcaattaaaataaaatctttcagaagcaaatgtttaatttctgaagtacagatggaaactactactttctcactctaacaacataaatgaactattcaaagctgatatgtaattcatttctcatttcattagcttaaacatcagctgtgggtgtactttacttacactatggacatatggttgcttggatcaaactaggagtaaatttttttaatgctttcaagaaaatacaaaatgagtataaataagtaatcagtttatggtaatttaggaagaatagcaaattgacaagcctgtctttactccataatctacctaggttttcagaaaatgaggtttagacattaatatacaatcatgctatagaattattgatcaaagagagggataccttaaacacatccattctaatcaatggaaatgccaggtaggataagctgttctgaactttggagtgtagatttatcaaacaaaggcggccttttggtcaacaccccggcgacttcaaagtatcttgtctattttacacagccaaattcagaaccagttctgaactcttttgcagcctatactttctctgcctactttattcagaatagacagaataatagctaccattctcactcatcttggcactgtgctaagcattttagatgcatgtctcataatcctcacggaagccctgtaaggcaggaactattactatcctgatttacctatgaggaaactgaggtcacatagttaataagagattggctggtaattgagaatatagagccagctctctgaaccctaaatctgcactgctttcttttgataagtaaagtccatggggtttctgaattgctgctctcctgggggaattcatgataattttctgacaatgcagttaacagacctacacagccaagttctcctaggccttgagcttctgtctggtagtagcccaaaaatatttcatcccttcttaatccttgataaatttattatgtgcatttgaaagtaggtgaggatacattattatggaattaaataggtcagaaaagaattcagactcattacaataatgatctaaaaatgatatcaccaaattgttttctaccattaataaagcccagattaaaatatttctaattataccattacctttgaaaattactggtggtaaagaaatttgcctttgaaagctcacataatgctaagtcatcatttctttaggttatgttaagtaactgggagagaattaataatactagaaagtggcattaagcatataaatgacttctacaaataccactttatactcttctttttttcatttattcaataaatgctaattattgtggttcatatatatttaatatttagggagccaatattatgtatcaagaatatgtttggtacctcatagatcatatatcatacaaatcaatgactagtaaggatttcaccatttttcaaatgatatgtcccaaagtactgacctactctgatcctttatcacacatcacatggttaacaagagcagcacttttgacctctgtgttatactctactctatctttcaagaatatctggaatatcttcaaaaagtaaaaaataaaatactagagagaaaggacttagatatagcttcatgaagctgatacattatgttttccccctctggcagagtaggttttctacatatgaaacgctaatcatttaattagcctgagtgtccacctttgagtctctccagtgacttagaaactcatcttctttccctgtagcttaatttaaaaaatcttcatatgtctacataatgggttaatattaataaataatatttctgatttaattatattaaaagtgtatccaatgaatttttaatatgatgaagattaagctctttcatgcttttcctcacatcattttctaatttgtttacatcacagtaatcatttacacaaatgtgactacttaaatattcaaagttggacctgaaccaagtaatgttctatgatgacctttgttcttttatgtactactttataaattttatttattttaaattgttaataaattttatttttttaaattgcttggttttctttgcatttctcagtaagaattctcaaatgtttaaattatcaatactatttttatttatgttatgttaattaactgggagagaattaatagtagaaagtggcattaagcatatgaataagaagttcgtgcaactgttttggttcatgcaaatagaatcatactgcatatactttttgtatcaactttcactaaacattaaatttttttctatgtaagttgtatatggaattattcattctcattgctgtatagcatgtcattatactaaaatgtatttatccagtctatggttgatgggcatttgcataatgtttagtttgggactataatatatatggtgctatgaatatcctagtagatgttttttggtgaatatatgtgtacatttttagggaatatacatatcagtagacttgctgggccatagtatatccatatatttcacattagtaaacatcaacaatatcctaagtggttggaaaaatttttacccctatcaacaatgcctaaatattctagttgctctgtatcttccctaatatttggcacataccatcttttactttttagctttctgcagagtatattctcttgttcccttttaatatctcttccagggatctggtttctgctagttaagactagggattactttgattttttaaaaaatctactcctgcatcttgagtttagactgttaaatcttcctcttttagaatcactcaccatcctattgctcaagatcaaatcttaatttcttcactttctaccattcagaaaaacagttacaacagggaaaaagttaaagaaaaatagaaaggtaaaagggctccaaggtctgtagtgttagcaaaatgctgctcagtactcagagggtatcctgaactagaggaacagggaaagaagtctagagtaaaaaggtgcagaggtttaaaaggtacagaggtttatagggtgggatcacatctagtaggagaaatgtatcttcctttgaccagtggtgttgaatgaaggtggtccttcacatattgctggggattccttggctgaaaataaatagaattgatcttacctctacaaacttcaactctctttgcacagttgtctataattatgtgtcagagtagaaccatttttccaaccttgtctatctggtatctttctgcccattcttcagattcagattattgtttatttatttacttttataaatttattttttattgatacataatagatgtacatatttgagggtacatatgataacttaataccttcatgtaatttgaaatcagattcagtttaaacataagcttctctgcgaaacttccctcaatcagcacccccacacttgcctccaagtatattaggaaatcctgtctcttggacacgctaatgcctgaaatatacgtttattaaagcacctgtgtcttagccaggcatggtggcatgtgcctgtagtttctactacttggaaggctgaagcaagaggatcacttgagccaaggagttcaaggcttcattgagctatgatcacaccactgcagttcagcctgggtaacagaatgagagccccttgcctctgccctacctttttgtaaagctcctatgtctcttactttactgtatgtgttttcttgtactcagccacttctaaaatcctgacagaaagctctcaaagtataaactctgtcaggtcactttgtttcctcaggaaagtagtaggtagtagagtaagaattcaaaattaggcactcagactcagagcctgtgcccatagccactatgttctattgcttggatgtaagaataaccaccctgagacatacccacaaaacattgcaggacacttaggataaagagaagagctacatctttaagagagaaaagattatcagcaaaatattaaaatcagattggcattagacttttcatgagaaaggctagataccaaaggaaaaaacataaaataatgccttaattctaagaaaaatttattttaaacttgaaattcaatatccaaccaatccatcagttaagtgaatgatggcattatttcagacattcaagtacacagaatatttaatttctattaactgtcaggaagacacttggcacacatactcttaaaacaagaggtgaatccaaaagatcaaaacgtggggctgaggaaatagtggagttggaaaagcagtataaggaatacccagagagtattgagacaatatgtaaacatgtgatatatttgagagccagggttctcactatgtaaacagggaggtactgctaaggaatgacaaactgctgtggtaagacaaagatgaaccccatgggactggactgaactgaagatgttggcttgaactcataattttatatgcagatataaacataaattgtatatacagatatatatgtgtattatttttgtgcaagaatgaaggagaaataagaaaacacatcttaatttgcctatcttcacacacatttttaaaaaagattcacattaaggataaaggaataagaagacttgttatatacaaggaatcttaagagtaaggtagaagggatatgagaagatagatttgtctcagagtagtttttgtacatttttgacttctgtaaactttttaagattctacaataaaaaaaataaaattcaatcaacaagggtagggagttggggagaggaaacctaacaccaaatgcaaatagcaataaattaatgaatgaatatgtttaaaatttttaacgtgtgcaccactgagttgctcatacttcactattttctaaagttgtgttgtttaatacagtggccaccagatatacgctgctatttaaccttatattaaaatactataaatgaatacaattaaacatttatttccttagtcactctagcccaccacatatggctaccatattagatagtgtagatatagctcagttctatcatcacaaaaagttctattggacagcactatttcaaatatttgcaaatcaattatttgtgaagcacctgtcctctgcagggcactggtttaatgttggatgagtgatatcggtatcatctttgattctgtgtatatctcactactatgagttaaaaaaccctaaagaaaccctctctggcacctcaaaatgccctgggctattgcaaaattgtattttagctcctatctaatgatacaattcttagctttattggtcaacatgtatcttccttggtataaatatagatgactacttaacaacaaaaaacatagttttccttgtagtttgagaaattatagattatctctttgccatattaattgtgttaatcccttgaagtttatgggattctacagctgatgaaattgtactaattgcaatatatgttaacagtgtctggaatttcagttccaatttgttactttcattctaacaaaactgttaattaattttaaggagttgtaatactacagtaaaagattatggattcaatctcattgatagttgtgattttattttccgcattagctgtatttcccatggaagcataagagcttcctatatgcaaggggtacaaggttaagatttttaaagaacaggccaggcgtggtggctcatgcctgtaatcccagcactttggaaacaaacaagaaagatttttaaagaataaatttatttttcctgtatttgatattcatttattttgaatcctcctactattacacccaatatattaacttcggggagcccaaattaatacggcttaaacatataagcatgtttaactcatgtaacatacttttctagaaatctgaatagaaattgattgtaaactttttggctgtgagagtttggtgaactgaattattacttttaataatatttgttgaatgaatgaagaaaactcctgttttaaatgcagtaggggagcttactatttaaggcaactgaagtaacttctatcataaatatttacctcctaatttctttttctttttaaagctgaatttccacatgttggtttacagacactattttaaacaagtctatacaagaaaatgaagttttataaccatgctaagcatgtttaaagtagttatagaaatccaaaaactttctgaatctatgtaaactatgattatgaaacatcagaaaacaaaataagctaaagttcccttctataaaatgaaaaagttggtttagttcttctcctctagcatagttactctctgattccataagtttcttcacaatcatacatgcattgtatttattttctctggctatatctggttacaagcagaaattcatttgaaaagaataaatggaagaatgagagggtgggtagatgactggatggctaggtgggtggataaaaggaaagaaggatagtagtaggagaagttgggtggatagatgcatagataatacgatgtgtgaataaagagaagtagagatttatttttataactctcctacatctcccccaaaagtgaattaaaagcagcttttaaaaaagagtcaagtgtgcaataagctttaaaacaaggccaacaggagccacataatcaaagttagggagcagaaatataattacattaaaaatcctagagttaaggtacagcaattaagtataaaattgattgtttgaggtccaggcaaaaatgaagcaatgggttatatggttcatattacctactaaaaggaacctaagcactttgaaattttcaaatgaaaatgataatttctattttcatcaggatatacttgaaaagacttttccttctcaatgctgtatactaagaggaataaatgtatcatgtatttatttatgttattggttattaaataataaaatgaacaatagtctttacaaatgatgttaagaaaatgcaaaagcattcttcataagactatttattttttacaatatcagattatcgtctgcagagagttaaagtactagagttttgatttgcacctacctgatatgacatacagaaataggtcttgatttgaattctagagagaaagtcaatgcataaatgaataaatgatctcaacatggcttttgacagaagtgagtcacaaattattcgaaattgatgtcaacagtgagttacttcttgtaggatggtcattcaggtttatcaggcaaaagaacttccaacacttgttttagaaacaaaaatgctaatgatgtaaattgatattctcttgtgaaaatgaaagtgacttgtatcagctgcattttattcctgagacagaaagcctcagatcaggattacaaaatatgataacctatatgacagtgtccatcataatatctgatcgtttggaaataagagaagacaaacatctgatcacttactaagtaccagttattttgctagtgatttacacgtgtgaaagcagtaatgtgtggtatgttgaggcttgacatcaaacttcctgattgggggtctcttccctgattgcattttctcattgcattttatatgcattgtgttttctctgaagttttacaaggctgtagtcctgtgcaaacagtaaattcattgctcggtaaactttattataacacagtagttttcaaactttaccatgcatcagaatcaccagaaaggcccattaaggccccacccatggagttcctggttcaataggtctaaagtgctgcagaagaatctaaattttaacaagttttcaactgatgtggatactgctagtccagggatcatctttgagaatcacttttagcagatacaattggttggctccccgaatactcactaccaacattgttgctaaaagaaccatgaatttgttcaaacgtccagttacatctgagaagagggaaggtgatgcagttctcggtcagttagagtaggttagtattctctgtgctcttcccatattgtattaaagaaggaattttattgtaatagttgttattgtttgtcaccctatttgatgttccacaaagggaagatacttagaagatatgtgtgcataaattatatatatgtgtatttatatattaatatatatctgtctgtatatatgtatgtgtatgtgtgtgtatttggcatatatatacacaccaaattatatgtgtgaacacataaattatatatatgtgtatgcatatatatgtgtgtctatatatgtgtgtgtttctgtgtgtataccaaacacttttgtgtacatatatgtatatatgtattataatatatctcatattgtatatcaatatattataatatacctcaatatatcatttgatgtggaacacatacagatatatatacacatacacacatgtatacacacaccaaatttggtatataaaacatgcatatacagatacacacacacacacacacatatatatatacatacacatatatatcatttatgtgtaaacacatatgtttcgtatcatcagtttctcccaccaaatttactcttctctctcctcatgtatctcccactctccatgttcaatcaatcaatcactatgtcctgctgattcggcctctcaaatatgtttctggcacatagtagatgctcagtaattatgcactgagtgaatatgcctacctagcacaagttctatcaattcaatgatctaacttctatgcatcataactcacccagttttacaagtaaaacatataatgattgtcttttaattaatgcacctactaactttatcattaaggtcaaaggagttatcattaagttatcattgaatcagttgctgtgaatttcgtgtaggtctctctcaatggaaaagtttgcttctcaaaccttttctgttcctattcactaaagttctgccactgcaattcttggctgtgcctcaatagtgcacacacagtacatttagtatattactgatggacaaagctctgaagttaagaggattaataaggataaaacccaaaatacctaaagctaatatcaattcactgagtcagcaagaatgctctgaaaaccttttattttgaggcatgaaaacctctcacatatcattttattatttctacctctggaattctccaaatcatcatgaggctgcctgcaaatgtagagagaaagtatatataagcaattttgttatttttaattctaataatcttaaatctacctacttctttctcctcaaaagacctcattaccttgcctattatcctcaagatgcctagagatgcctagagagacagatatgagctaagatctcattttttcaggctacctccttctatccttctatgcattgtgtttttcttttactgcaggaagaaatcatttcaatagatatttacttattgatatgtataagttttgatgatcacaaaactaaggttcagtcagattaagtattaatgtctaaaactgcatagctagcaaaaaatgaatcacaaaatacttctaaaaatgaagaattgtcctataaagcttttaaaaggttaacaatctctttgaggtaaaacaagaacataacaaactactggtggctgaaaatgtagattttaattatgtatttataatatgatttcaatatattacctgttatatatttgcctgtgtttcctactaactgtagaatacaaggcagaataacaaaactgccaaaagagaatcatataaagcttcagagacattaaaatgagaaaaagtagagttgagattgtaatatctatcaatgtagtaaaacagggaaaaaaaagctaaaagttagattacaacaagttgtaatttaaactttaagccaaagaatctattcttaatttgatagatatttaatggcctttagaaaattccagtagtattctaacatgactagtagtgagaaagtaaatctgctacttgatctgccttaaaatttcctgtacaatgtaattcattactttttctgtgaattaatcagcattattttttcttttttctttcttttttttttttttctgagatgaactcttattctgtcgcccaggctggagtgcagtggtgcgatctcggctcactgcaacctccgcctccagggttcaaacaattctcctgcgtcagcctcccgagtagctgggattacaggcgcctgccaccacgcccggctaattttttgtgtttttagtagagacggggtttcaacatattggccaggctggtcttgaactcctgacctcgtgatctgcccacctctgcctcccaaagtgttgaaattacaggcgttagccaccgtgcccggtcatcagcattcttgacaagaaaaaaatcaagcacctttctaatagactttcatgagattatgacctcttctaggagattagactggcctcaagtaaccatcatgctaatagcccaatgattgttaacgagaatctttggaatagttgcatataatctaatagtgattgtctaatcatcatgttttaaatgaatcatctctatcaagaggacatatttaaatttactttttctaaagcctatttccttgcagcatgttggaaatagagttttatcatccggtcataattaatttgtctgagaagttgttttaacagtggttttcaactctgttccaatgagagtgtctcaggaagcactgtgggtagagagagaagaaggagggggtgaggagaagccctactgaaaatagtgtgagttcccacactcaatcgctgttacaaagacagcagcactttttcatctgttctatatatttaagttcagtttcactggaataaaaggttgtgtaatactaaaaagactggaaatcattgctctacattatgaatatagaagtcttgtataaaatagaaaagctgaaacaggaagacaagttaggaggttttagagtaggctagaagaaaagagttcataaagatctgaatgaggatgttggcagtggaaatgaacaggttgggacatttggtactgagatagaaacttcacgattttattgctgattagatgcagggaggtaatgcaaaggaagaattccaagatgactaaggtattgactaatcctgatgtctagaagaaagtgggcaaactattatcagtaataaaagagccaaaaggaaaggaagtctcgatgggttaataagagtctattcacgttgagtttcaggtaagtttcaagtccagatacctattagacagtcaggacagagagagagagagagagagagagagagggatttggtaaacatttgcattgggatgacagttgaagccatggcaataggccaaatcatgcttgatattaggctaatttccctatagtttgaaagaggaacttggtagtcataattaaatgtgtctctgttgatagcttcacagacttttaagacaagaggggattcatccttttggtgacacctgtcatgttacaggaatacctgtattgtatgtgaaaggactgtggaactcaaaattactgttcaaatgtaagatggaaatatttattgacattattattacattgtaatagagacttaacctaagacttgtcttttttttagaatttgttaatgaaactgcatttatctaatgcactataagagcaatatcttactgaaacattctaagcgtaggttaagaaatgcataatcgttggcttggtaatctctttctgggcaataacagcagaaccaacctccagcaaagaaagcttagtagcagagatcctatctacattcagaatgggactcagtgtatttccctgataagaaaatggagaaagtggcaccagaattgaaagtttgtaattgtaggacatggtaggtgattgcacatgtagggggctgggacagagggaataccttcagagattacttgcaataaggtagtgtcagtttataaagccaagacaaaacagaaatcaggacaccataccaggaagaaggaatcaaaaccagactcagctgaccctaaggctacaaggccacaaatgtcgaactttttcctcagtgactgctgctgtcaactacaaaataggctccctcctggtaaagatagcaggtcacatatcttagttaccgctcaggaaataacctgtcagcacatcatctctgaacacaaaggacaagataattgtcccacgttctgtcaggcagaagtcccagtcatctgcagaagtggtaatatggaacatggtgtatttgtattaacattaactcttttgtctctggcttcagtaggaaaaattttggagatggcaataacactttttagtattggatgatttccttagtctttcttaatgcaggggatgcatacctaacttttgtagttaataattaaggtatatctatgttgaatgattaagcaaaatcaaaaccaagactgatttttatttttttacactttctatttttacttcaaccagaatggaagaagtacacataattctggataaattccaaatccactgagagtatatttggtttatgtggtagggaaattagcctattattaaaacagatttttaaagatttataggaagaggcaagtagatgaaattgccctgtcagaatatttcatgactttgatgggataaaagtaaaactatatgatttctattgtactttctcagctgttactcaaattgattataactataaaggaatttcattttctgattcatcaccatattaaaatgactatgaagtcttctaaacaaaagcacgaaattctgtctcctcttctagtattcaattcacatagcaagatctctttaaaatggtcatcatattttgtatttatccctaagtgtgttttaaaaatagccaaggttagaataacaaaataaactcacacacacatgtgtgtgcatgcgtgtgtgtatatatatacacacacacacagatctatatatctatatatctatatctatacacacacacacacgcatgcacaaaaatcatgcctgttgattgattctggaaactagaagaaattgtatactgtttataatccaagggaggattatctgtatggatttcaagaagattttacttcactaaatgttgtgacattttacaaaatgttggttgtgtcatgctttaccccctggctttaacacatccacaaggctttgaaagcttgattagcaaacataaataataaaaagaaaagtagaactacttagggggcaatattaaaagatggatgtgctaaatacaaagcagataaataatcagacatgttatttttgccccactgaaaatccatgccaaaaatagtaacgactgtttttctttttcttgtccactttcttttgaacattgatacttcacattttgttaattctgaacaagactatgaaaatgttacatcattttactgaattgaaaacattaatgaaatataatgtgtgagcagatagattctatgagtttatgtgtgaacttacactagaaagagaagaatggcagtagatgtggggggttggaaggaatccagtcctatacacacataagagataaaaataaatttatttattttaaattcatccttgaaataggttaatcattgaaaaagacggatctacagattccacataaccaccccctggttccatccttgcaagccgggcataaatgctgagacagaataataaataaaataacaatttaaaataatttctgggaaaattatgggactatatacatggaaagaaacttcctgaaaactggtttaagaatacatttaatcatatattttcaaaaagtaattatatatattaaaaggtaaattttacatctgtaccaaaagtaccctgtcttttgccctctcttctgagagaaacattgcatttttctgcaatatctcttcctcgtgtcctctatcctacatttatagagtctcaaatatgctcagcctcaaaattaagatgctttgagcttccagaaaacactacacagataaaggtggctttcaaaagagatgtttcttattgtctacgtaatcatgcagagttaagcagtcactgcaacctttcatcattttctacaataaggccaactttccagataaccacttagtgaaacaagaatcctgtatttctatggtggagctactgcgggtctcatccaacctcctgccatgtttgggccactgactgtttgggcacttacgtccagcttgcgaggatggagccatggggtaagttaagtagaatttgaaagcagatgagtataataggagtacttactctggctttcagaatttaggcagagagaaacagggactgccataactcagtgaattttccctataactagactccataatttgtaataaactgcatatttaattaaccagttaggaggctatttttcctgtctggttcattgtttgtgtatgtgcaaccacagcagaaatcatgaaagcagcagcagcactgggagaacccagcctctaaaatgtgttagagtatttatctctgcaagatagaggtagttgataaaatagcaaggttaaagggcagacacttgcagatcaagcctttaaacaaactttcattttgaacacataccataacttagatgggttcattaaggagacacaaggcatttggaagtaataaagttagtaatggtttcaaaccaacactgtagggaaactaaacttattagaagaaaataatgaaataatcataaaatagctgacccattacttagcaatgtacccaatacattgtaatgtgcattatatatatatgtaatatataccatatacacacatacatatatatacacacataaaaaatacattgctaaagatgagataagagagttacagtggttatatcttacatttctcttccccagtatccatcaccctttcttccagccctgaattttctctcaggaaatcaccatttccctttcgtggatattttattgggagacggtacctgcctttcactctttaagccaaagagatcatgtcttctccttccccatagtatctatagacagagagttggcaagtgatctagtcagccaaaaagattgtctttcctcggattttgaatcttgagctagtgaagcaacaaggtaaagaagaatacaggatcttccattattctctagtgttacatattgttcagagaaacatttacaacatatgaaacctacgaaaggaaaataaatcttggagcccccaaatcactaatctaaagggaaaagtcaagttgggaactgcttagggccaacctgcctcccattctacttgaagtcatccctctgctcattgagataaatgcgtatctgattgcctcctttggagaggctaatcagaaactcaaaagaatgcaaccatctgtctcttatctgcctatgacctagaagccccctccctgctgcgagtcttctggcctttgcttcaagttgtcccgcctttctagacggaaccaatgttcatcttacacatgctgattgatgtctcgtatctcactaaaatatataaaaccaacctgtgttctcaccatcttagatgcatgtcattaggacctcctgaggctgtgtcacaggcgtgggtcctcgaccttggcaaaataaactttctaaattaactgagacctgtctcagattttctgagttcacaaacctaaaaatgctggattaaatatagttaaaaaattgtaccatgggggtagaagaataatttttttaaatcctcagaaattacaaaaaatataatcccagaagagaaagtaagtgctagagtggtgtttgccctggagaactctgcctaaagtagcaggttaattccaatgaaccatgcataaaagagaggatgaaaagtctgcaccatgagtgggaaggaaaattgtatctgaactatttagccttcactgcataaagcttgaactttcaaagcatcacactcattggatgaagtaaatctatactatccattcagagagaaatagttgggatatgtaaactggaagacagatttgaagaaactacacagaatgaaacacaaagaataacaggaatggaaaacaaaaagagaaggtaataaagaagacggaataaaaatcagattgaatatatgcttactaaaaggcccacagtaatttccagacttaagaaatttgaacaactaagaatagaaaaataaaaataatatacatccagaaatagtaaaatacaatgaggaaattttttttctttttttgagatggagtctcgctctgttgcccaggctggagcacaatggcatgatctcggttcactgcaacctctgcctcccaggtataagcaattctcctgcctcagcctcccgagtagctgggactacaggtgcctgccaccatgcctggctaattttttatatttttagtagagacgggttttcaccatgttggccaggctggtcttgaactcctgacctcgtgattcacctgcctcagcctccctaagagatgggattacaggtgtgagccaccacacctggcctacaatgaggaaaaattttttaaaatcaccattagaatatcacagatataatttttactgatgaatgctaaaattactgggcaaagcattaggagaaatagtacacttgcaaggcatgaaaatacttgccaaaccatatttattaaatatcctggtgcttgtattgaaaattctttgatacttctggcaccaggaggattatttattttcttccacttgagtataaactggacctggtaactcaattctaaacaacagagcacggaaagggagtagtagctttatactgaagaaacatggcaagtactgtcttaaacaagtgattgaagttaatatcactagttatataagtcatgttgatatggattcctgatactagatgatgagaaagatacttcatctgtgtggtattcttccctaaaatctgtaattccagtgaaatcatgaacactttagatacatacaaattgaaggtaattctacaaaatgcttgcccagtgctctttaaaagtatcaaggtaaggtatatatgagaaaaaaaaaattaaagtctataacctaagcttctactttaagaaactagaaaaagagcaaataaaattcaaactaagcagaagaaaataaattatacaaattagagcaaaaatcaatgaatttggaagcagaaaatcagtaaagaaagtcaacaaaatcaaaagctagttatctgaaaagatcaataaaatttacaagcccgtagccaggttaactaaaaaaaaagagagaagatacaaattactaatatcagtaatgaaaagggactatgacaactgatatcatgaacattaaaaagataataacaaaataccatgaacaaccctatactcacaaatatgatagcctaagtaaaataaataattccttgaaagatacaatatactgaaactcatatacacagacatagataacatgaataggcttatagctattgaggagattggatcaataattaataaacttccaaaacagaaagaaccaggaccagatagactcactggttaattctaccaaacactgaaggaggaaattataccaattctttccatctcttccagaaggtggaagcagagtgaatactttccaactcattctatgaggccataattcccctattaccaaaaccaaagacattgaaagaaaggaaaattacagatcaatatttcttacgaacataaatgccaagatttttaagaaaatgttaacaaaactaattgaattatgtataaaaggaattatatactaattcttttagtatataaataattttattataaatagtcataaataaatctacaaagaatcaagtagatttatcccaggtatgtaaacctgattcagccttcaaaaatcaattactataatccatcatatcattaggctaaagaagaaaaatcacataataatattaaaaggaaaagcatttgacaaaatcctacacccactcatagtaagaactctcagcaaagtaggaatagaagggacctttctcaacttaataaaaaacatccacaaaatgcctacagttaacatcatacttaatggagacaaactagatctcttcccactaagatcaggaagaaggcaagatgtccactctcaccactagtgaatgtaataaacaataaaaggaaataaaaaccattcagacttggaaggaagattaaaaatctctttgtagatgacacgattgtctatatagaaaatagcaaagaatcaatttaaaaagtcctggaactaattaatgacagcaagcttgtaggatacaactcaagtcttttgatttcttatacaccagcaatgaaaaactaaaatttgaaattaaaaacacaatgccattaacatgagcaccaaaaaagagatacttagtataaatctaaaaataatatctacgagatccatgtgaagaaaattacagaactctgatgaaagaattcaaagaagatctacataaatggagagtgagttccggtgcctagataggactcagtatggtctagatgtcagtctttccctacttgatgtacaatcaagttaatatttaatacaatccctatcaaaattccagccaggcattttgggtatttactaattgaccctaaacttaacagggaaaagcaaaagacccagaatacttgatacaatattgaaagacaaaattagaggactgacactacctgacttcaagacctactataaagctacagtaatcatgacagcattgtgtttgtaaaagaatatacataaagtaaaagaaactgtgaaaagttgtcacatttcgaaagacactatgaagacgtgataactaaatgcaatgtgatattctggaacagaaaacagacattagtagtgaaatttgaacaaagtctacagttgccttgcaccaatgctaattaattagttttgacaaatataccatgataatgtaagatgttaactttaagggaaactggtagaaaggtatgtgggcactttactatctgtactatcattgaatctcttctgtaaacacaaaattattttaaaataaatagtttaaaaaaagattctaagccaaatatctctcatgtaaaaacatacaaaagtcctaataaaattttagcaaggcaaaattcatcattacaaaagaaagatactattccatgcccaaattagatccatttcaggaatacaagtttattttaacattaagtaatctattaattttctaattcatcttatttacagattaaaagggaaattagatataagcttctcaacagatagaaatcaagtaggaatttgtgacataatttcttactcaaactaggaataaaagggaacacctttaatttgacatagcacattcacaaaaatttaccgcaaacgtgatattcaaatgtaaaatgttacaagccttattttaaaataggataatagcaacaaggataaacactaacaacacttctctttagcgttgccttggttattgtaaccagcacattaattaaaagcataaagatgaaaaaagaaataaaaaaatgtacaaactacaacaaacccagagcaaaggttaagaataaacagtgtattctggaagaaaaaaaagaaacaatagttatgaaaattttctttaccagttatcatggcattttaaatttagaataattaagatgcacagtaaaataatagagacagacatatagtctattggaacaaaagacaaatttttacacagacaatgcatttatacttgattatgtatctggctctgcacatcattatgggtaaaaaaacttttttatttaaacaattattattaaaaagtttttatataattggttaggcatatgaagtgaataaaaataaaagtcttatctcaatatacaaaaaaatacaaatggttaagatcttaaatgagaaaggcaaatttatttatttatttagagacggagtctcactctgtcacccaggctgtagtgtagtggcgcgatctcagctcactgcaacctcctgtccccgggttcaagcgatttgccaccacgcctggctaattttttgtatttttagtagagacagggtttcaccgtgttagccaggatggtcttgatctcctgacctcgtgatccgcccacctcggcctcccaaagtgctgggatatatagatgtgagccactgtgcccggtaaaacttgaaaactttaaagggcaatttttaagtcctcagtagagcaaaggatataaaaccacaaaccttgaaattttctttaacaataacatcataaagagaatgaaaaggaaatgtaaactaagaaaagatgaaatatatacaacccatagtatccagaaaaataaaaacaaccccaaagaaaaatggatcaatgttgtaccagtatttcaaagaagtgaaataaagagataggacaaacatattggggggaagaagctcaatctcatagggaatcaaggaatgcaaattgaaaacatgatatcatttagatatatctcatttacacattggccaacaattcaaaaaatctaagtctatagaaggttgttaaacatctgaactcctccttcactcctcgctgaagtagaaaatcagaaaaccttttggaaaacaatttggtatgacctcgtaaatctgaacagccacagaacctatggccctgtccttcagtcccaagcatgtatcctagaaagcttttgcaacagatgcaccagaattaaattgttcatagtagctttgtacataacagaagaaagagaaaaagaggaaagagaaaaagaggatgagaatgaacaaagatttgcactaataatccatacgctcatcagtagtacaataaatatatttcgatacatttatataatggggtaaagcatctgtatcttgaaaacaaaatgtggagaaagcaagttgaagaggattaaaaaaataaaatttgatcctacaatacaacaatataatactcaagagtatccgcccacaccactcacatataaaccatacacacacacctaagtattatgttgtattgactgtgtaacaaaagtataggaacaggtataaaaatgagcaatacaaatttcagaacagtgattaagtaagagtggggagacaggaccatgaggtaaggttaagtacatagatatttacttgatttattattagtagtaatattttaagtacatatatgttatatttactcttgtgtttgatatatatttcctagttttcaaaggttcaaaacaaaaaatttcagtcatatgaacttttgtggttctggctcctctcccttctgcctctccctggtggcacacgcaacttctcatgcctgcctttcacatgcaggctcatcctcagcccctctctaacccccactatataaaagccctgatttcggctagccaagttaatttctcttgcttccacccaagaatctcttctgaaatgcaacataaacataatctttccaacttagaatgacaaaaactatctccctaggtatttaagttattagttgtattacttttgtttcattaattgtagttttattgattttagatcatatgcacacacatatcatgtttgagcttcttttgctgatttctataaaagaatttgtacaaaacagtgttgataataatgtatccaacacatagggacacatgaaaaactgaaaagaataaggaaaaaaaggtgaagcagtcaaccctattttctcaagtggactctgcatttggctcattattcaatctttaatcctgtgttaccttccttccaccatcctgattcaaaatccccttaagcaaaatataattagcacaaggagtcaactgaaagtaaacatatatgattttaaattctgatggtaccttatacttttctaggtgctttcatggtgaagtcttcctgttcatgaagtagacagtttaggtgttgcctgttttacaaataaggaagtcaaggtccaggcaggttaaaagattcatctgaggttatagagcaattatcaatgacaactctgatactgatgctacagattcagagaggattgtcttattcttaaaaagggaaaatgtatataaagcccttgttacaatggtggacacatagttaagtacttaataaaggcaaattctctctctcttatcccttgcactttgcctcacttatcaattccatgcagctgattattctggtctataaatctaaagtctcagcaagaatgttgagtgaacagtatccaaagtcacatagcggcttttcctatcctgacccaactaaatgtattttgcaaatatgtcacttattaattattactacacaaagattatcacataatcccacattccaagcaaataataaaaaactgtcacatacctaaagggttagaaaaaaatccagattttaagcaatacatagacgcagtgtccagatacttaactaaattttttgaaggttccatgtggaagcacagatagtggacagaccacaaaactggccatcagccacctggattttgtgttctgtagtttgactttcagcaaatcacataacttccctgagtctcagcctcctcatctaaagacagacagtttaactaggtattcaataaggtccttccctgttctgagtcttcttttatttttttaactgccacaaatttatagtatcttagtgttactgccaatatagaaagccaaatgacagcttcaacgctggtgtttctcaataatgcactttatgctatagcacagaagggcttagtgaatcgatgatggtgccaaaattagaatttatggctgtgcctaatctattgttttgctagtaagccatactgcctgatactgcctccacttaacaataaaacaagatttaaagggcaaaactgtatgatttcatactggcatatgcaagggtaaaattgaaagacggtactataaaatcatctcaccataacgaccatcgagtacttacgctctgcaaaaaatgtgtacttgtctgcccttgccagacagatagcaatatttggttcaaaggattatagtggagttaagaaaaaaagaattaaagactggttttcgtatgtctgaaagctttgcatacaaaagtacatcatggaacgacactcactagaaaaagaacaattatacttctaaaagtaagagatttaataagcaatgagcttaaaactaggctgaaagaaaagttaattgaagtctaatttatctctttctggaccctaaattactaacaacaaaaaaattagctaacagttactgaacctgcgtgtcaggcacaacggcaagcattttttatgtgttaattcacttaatcctcacaagagccctctgaattagatactgttaatattcccagtttatagatgaagacacagagatttgaagttatataactagtacagagcagaacaggaagcaagaatagtttctgttaaacatgtgaccttcttcctgtatgtaaaatggccatgttagtaatttttacatgtgattttcatatattcataaaggagtgcatgttgaagtctgcactctttaatgatgtaaaataaaaattattaagaactaaaaataagttttatcattatagtatctggaaaatgttacatatcatttgcatgtgtgacattaactattttaaataaaggtatattgaaacttaaaaaattagacttgttccacaaacatgaacaagtcagtttttagtcatgattctaaagatgcttttatgtgatattgtaaattgatattagaatatgtaagtggctccagtcatctttaacacttctaattattcagagagatgacataatatcttctgacaaattctgatttgctattttcccactagctgtttttttaaattgacaaactccaaattttaatttgatttaggatgagaataaataaaaatggttgattctcatttgcaaactgtgacactcattatgaatttcataaaaatcaaaagtattgcattttattgatctaaagacttaagtttcatttttagtttatttcctgataattcattttttgacattatctaaaacatatcctttgcaaatacacaaatggagaacattagtttcttaaataaggtttactaactgagactgaacttgcttgtcaaatgtgccaagaaatgcaggctgctgctcagctccattaagcagccactctgctggtttaaatattttccagagtgggcagtagttcctgaggcatacctggaagagaggttgacagggttgccatactgccaccctaatttgcaagaccaaagtctcatttgagcagggttttcactgaagcatcatgtctaaaacacatctttgtttatactgtaggtggcaggatttttatgctttaaacattttgctataaccctgcattttttgcaaatgaaaatttaagatgccatcagataacattttatgaaaatatttatatggttccagaaaaaatagccaggccttgaaggtgggtgcctttcattcttggtattgttcataaattaatatacattgtttgatataatcatatttcacattaggtttaactttttctctttgttctgcaaattcgatatttttctaaattttgagattcaataaattaaaagcactaaatattgaaacttaaaaacagaattcactcctgtttaagatttgaaaatgggtatatctgcattgaatccaatatgccaaatgactttatttcagacttttgagtaaggaatataaatttctgaaagagggcatcatttttagccattaatatctgaaaaagatagcaatttataaacaaaaacaaaaacttatcaattctttgcaagcttatgaaattctgaatcaatctttttattttggcttccagtagtacaaaatgtttccattcacatttgatatacttacatatatttaaaatcatcactattttttcataatatatgaaaacatttttatcatgtctttttaaaagcaaattatgtcagtgaagacaattttcttggctaacccttgtacaggctaatttgcttatattataaacatctataaaaattcatgttttattatatatttcaaagctctaaaatgaaattaatcagggtgacttgaagttcatcaggacaccttggcttcttcttaaattgaagttgacatatgctcttccttaatatctgtttcttactctacttaagggaaatggcaaattatctaaaagttaactcaaattgcttaatatgctatttcagcctttgcatttcttctacttggcccatactctcaactaattcaaaaagagttctctatacaaattcctacatttaccaacagtaaaatggctatcactcacgtctacttaagatgaacaactaatgatctattttgtacaaatgtgtttatgcaggcattttagaggaaattttatctccttaggtaaagtttatgaacctttctcagtaaaaacatgagacctagaactatatatactctgctcttatttgaaatgcttcatgagttttttcaccaaaagtttacctcagtgtttgaaatcattatgtgccatcataacagttacacacacagacatacacacaaatagacgcttctaataacaccttttttttcgtctctggagctcaaaattctgtcattaaggctagattccgggccgggtgcagtggctcacgcctgtaatctcagcactttgggaggccaaggcgggcagatcacgaggtcaggagatcgagaccatcctggctaacactgtgaaaccccatctaccaaaaatacaaaataatagccgggcatggtggcgggcacctgtagtcccagctgggaggctgaggcaggggaatggtgtgaacccgggaggcggagcttgcagtgagctgagatcgcgccactgcactccagcctaggcggcagagcgagactccgtctcaaaaaaaaaaaaaaaaaaaaaaaaaaagggttagattccaaccttatatagatagggaaatagggaaatgagggacaaaaaataatatccttggccaagtgcagtggctcacgcctgtaatcccaacactttgggaggccaaggtgggcggatcaggaagtcaggagttcgagaccagcctagccaacatggtgaaaccccgtctctaccaaagatacaaaaaataaataaataaataaataaataaataaataaataaataaataaataaaataaaaataaaaataaattagctaggcgtggtggtgagagcctgtaatcccagctacttgggaggctgaggcaggagaatcacttgaacctgggaggttgcagtgagctgagattgcaccactgcactccagcctgggcgacagggtgagactccatctcaaaaaaaaagaaaaaaaaaggcaaaaaataatattctcaatggccttttttagaataatttttacatttttttcttgcaaacatcagatattaagcctttggtgctatctttcatgactttaccactttctactctgcaacatatttacatagtaaactgtgattttgacatagagatattcgtcacctttaacagaaaagaagaaatctgaagcccacagaggttgatttatccgatatcatatggacaaagcctagctctcctaattctaaatttagttcagtaccccacgatccatttctgtaccctaaactatttctataaattgcctttatttgggcaataatagatgataatttgtctggaaaactgggtacattccatcaagtgtgtctttaaatttggcctatattccttggaaatccatgctatgctaaattcagtttctagaatgttttattctgtgttttcatcatgcctgaagagggtaacataaaaaagcaaatatttatttcccattattctaggccatattccagttgagcaataatatttgtttatacataactttttttttttttttttttaggcggagtctggctctgtctcccaggctggagtgcagtggtgcgaactcagctcactgcaagctccgcctcccaggttcatgccattctgcctcagcctcccaagtagctgggactacaggcacccacaacaacgcctggctaattttttgtatttttagtagagacggggtttcaccatgttagccagccaggatggtctcgatttcctgacctcatgatccacccgccttggcctcccaaagtgctgggattacaggtgtgagtatatataactcttacttttggaagttgaattaattcactttttcctagactgttgtcctaaatgcaataatgctccacattctatcaaagtgtaggtacagtgtatcccagaatcactagaaaaaggtaactatatgcccaccttatgtagaatacttgaggcatatatatccaaagaatatatgttctacagattgtggagagcacgtcactaattaggaaccaagtatccaaacacatagatagctaccttcaaaattatcttggttaaaagaatgacagaaatcagaaagtttgttgctcttatggtcattttaggttttcagtatttttttcctatggcaagttgcactagctaaaagtagcataaagagagttagagagaatcacacccaggtgtaaggcaaagctgaatagctgagcttctgaagtctttgtggctaaacttttcatttttaagacatagtagtcagtacaggaatcagaaggtggaaccatctgcagctatcagcttatacagagtacatgacagtgatccaaacagccacaagaataagcagtcctaacagtagcatggtgctttacttcacttagtacagtgacagggccttgacccgcaagctccagcagaaccccaccacgtgtgtgatgtgtattcaacctgcaatggtaacatacagcaatacattaggcacacagtaatgccagaagttttaatattagactcagaaagataccacaactaaaaatttctacatggggctcctatatgcatagaactcttgtatatggaaaaggaatatgggaaaataattttttttacgttgctccctgatagttactctcctggggaatttcagggtcctgatttttaacttctcctatctcctgacccttacgtagatgataagactttttaaaagccatgttctatcttctaaatgttgggttttggtagatgacttgctacttgaataatagaaggtaaagtatagctacatatagtttaatgttgtaattatgtaaaacttacaactaaacaaagctgctacgtatcactattaagggtgtgcctaagagcttttgtagttataataattagccacatataggctattttagtaattgttataattattttcatctaattaattgaaatagatttttctcattttttagtactctagtatctaaaaagtgtctgcttaatattcatgacacactctcctgactcacttgcttgtgtggctggtctccttacccacctcccagtgccattcagttaaaggcaaagtttccgaatcctaaaattttctacatctcactatgtagttaggccttgggtagctatcaagtacatgcctaacttgcctgcaacaatctttcttagaaatttttgagcagtgtttttagctgcttcatgattcctttcccaatctacaaatgtgtgtttttgtgtgtgtatgtgtgtgttgtgttgtgtgtgtgtataaatacattgagggggagtatatatgaaggctgtcaaaataatcagagggttataaaccttagaaactctgagtccatggattgcagattgttttttttttttagacagagtctcactctgtcaccaggttggagtacaatggcatgatatcaacttaccgcaatctccacctcctgggttcaagagattcccctgcctcagcctcccgagtagctgggactacaggcatgcatcatcaggcccggataattttctgtattttagtaaagacagggtttcaccatattggccaggatgatctcaatctcctgacctcgtgatacacccacctcggcctcccaaagtgctgggattacaggcgtgagctacaatgcccggtgggattgcagattctttaaaccaccaccaattgtcagacagaagaaagaaggggaaagaactaatgttacaggtgggaagaggtgaggagggagctcaaacacattgcctgctgaaattcttagacacaagccttgaccatgataaactttaaaatgaaatcacacaaatcataacttcaccattaccggacgaaggaaaaggaagagagtctagattgagaagagagagagtgtatcttcccccttccttatttaaaataataaaacctatcatttacggagcacttcctatgggctggacattcccgtaaaactctgcatggcatatagcctttagttctgacaaaaagtcctatgatgtgggtattattatctttgaagctcaaataagattaaaaccagtaccaagatagatagctagtaagtgatcagtctggatgattcttttgcctaagatttgcttctgtttcacagtgtttgggggaggattaaatgagagtttccaatgaacttaccaactcttcaccatggtttgtccactttgccaatatcatcttccttttattcaagtaggctgcaattgcattaactttgttttcagactctaaagctgggagataaaacactgtgttcccaaggcgtttgctgctgttgatcctctgcctagagttctcttctcccagcttgtacagtgtctggctccttctcctcttaactctcatcctaaatgtcatccactctgagaggccttctctgaccacgtagctatagttcctactactgtttgcatgagtagcaacttctttacttgattacttattatttgtctttctctcaagccttgggctgtgagggtaggtgtatatctccagcaattgccatgacaatgacataaagacactcaacacacaagtgaatgaatatatgcagtaaagcgtaagagcctgattcagagcctggtacacatttcactcattacatcttaaactcctccattctctaatagctacaagaaggcaaatgggtcagaaaaataatgaatactgaaatatttcccttgtctacaaggtgaatttggtaaaatgggaggccctcagatttctttgctctattttaattcctgaatttgagacatacaaactatctcatcctccctggcccagaaactttaggtctaacagacaattgaagcaaaaataaatatactcatacatacatacataggattaccagtgtatgcaggctgcttagccttcaccagtcataggaaacatctcagcaggggcccctgtttcatcatagctcacatgttcttccccgggagctgcacaggtaacatgaatgagtgaagctggcccagggacagcattgagcacaagactagatgtcctagataaagaaggcagctccaccccagctttagctaattcataagtgatgatgccatgatgaaataaggcccaaggttgccaaatgtatctttttttaaaaaggctagaaattagatttgtatataaaatctttctaattataggtagcaaaaattaatttaaaaattttaaaatatcatgtgtggaaaacatctgtgtgattatgctctcattgaccatcagttcctaattatcatgatccaatatcattcttttttccttttcttcttctcttccctcaaggggacattcttgaagtatggcagagaaaactctaagttcaaatatactttgacaagatctcaatttcctccaattagaatatagaatcttcaataagtttttcaacttctctgagcttcaatatcttataaaatttgagatattattggttgaataaaatagagtagaacttcttcacaggtactaacatttcaataataatttatataaaaacaattaatttagtgttcaaactgtcttttacaagattgaacacaatacttataaatttcaagccaatctttagcatcacttggataaaagtcagaagaataaaaaacagtaaaaatccagttttaaaaaaatcatatcataattaagcatctgcttttgcactcagttgtgtctgtcagtgcaaaaataagtcccctttaaaatagaaggaaagtgacagttcttagaaagaaacttacgatgtgtggtgggttactttttcactttttcatggacttaccctttcatctccaagaagatatggaaaaaactgaaggaggcaaaggttacatttttcaagggtaatagtacaccgtggttctttctttattaataaattttactgagatagcttattgctcctttttttttctctactagaagtaagtaattttcctccttaactacaaatgatttttaagtaaataccagttttactaaggtttccagattcccagttctaacgccacaatccctgatgacttaatgtatcttctatcctggccccacttcattattaataatgacagctgactgatattaggtcaaaatatggaccagagatgtaagacagattttgtatatcctgcctctagtatctacaacaaccatgaaagaaaggtcttatacccattttatgaacaatgaaagtctcaaaggagttgaatgacaagtattaaagggctctgtgtttgaaccaatccagaggcaaggggctctaaaaatctgacttctcttgtgtgtgtgtgtgtgtgtgtgtgtaaataagtgctatggtttgaacactgatcgtaacttggttttgtttatatacacttgctaattatttctggtatttcagatttataccacaaagactattttcaacttgcttatttctcaggccagatgttacagagaaggatgaggctgataaaaggcaatatgttaaaaatttcttattaaatgagattctgacctaaggagaaattattctgtaatatttcatcctcaaaacaaaggtaacaagtttattctcttaggaactggaaaagctgaagcccatatttcctacaacatgataaaactctaaaacatgaaggcaaataaacaatactatcttaagccagtctgaaaagattttaaagtcagtcacacctttattcccttcatcttaacatcataacttgtaggaaatcctcacttaacattattgataggttcttgaaaaccgcaactttaacacaaccaattttaacgaaggttaattgatataaacaagagttaagctcccatggcatgtttctggtcacaaaaatatcaacaaacttctaaataagacaaagagactttcaatattgagtattgaaataaatgtgagctatacttaccattaagaaagacaaacaaaaacaaataaaataatggtttacccaatttttggtgaatcagtgagtgacagtggtggtaaaggtagtgggttaaatctaagaataaatattcgcaaaagtgaaaattgtaaagagcagctcttctatcatgcagttctaaaacaatcatgaacagggtgggctccctgagcacttttgcactgcatcattttatgtagtgaatttgtgggattattgtctactttatgaacttttattttacagtaatatatattaattaactcattaattttttaattccagttctgggtcacaggtggctggagcctatccccgaaactcagtgcacaagaagggaaccagccctgaacaggacaccattccatcacacacagcaagtactaaacacacacccacactcactctgattgggacaatgtagacaagccagttaacctaatgtgcacatcttggggatttgggagcaaaccagagtaccaagaaaaaacccctatagacaccagagaatgtgcgaattccacacagacagtggcccaggtgggaattgattttctccccctatcattgtttataacaacaggagttgaacaaaatgatattattcaaggacctgctatatttaacttctaatacttatttaaaatttcaattatccagttgacagataattatgttttaaaacaagtaatataaatttaacttgttgtctagaccaaaacctatgaacttttctcaataactgattacggcagaataaaatttagacaaaacgtttacttaaaaagaattgaatagcagactaattagtgatcttaaaagcacccataagatagatgaaagttcataaaatgcacacatattcaaaaacaaattagttcagtttcgcattacattcaaaatataatttttttagacattcatgcttatatcaaatgtaagtgaaattttgttaacatagtctaatgatcagttagacaataagataaaatacaaattttaagtttggaaacttaatgcaagtttaatacattaaaatacagagaaaatggtgatgtttctaagaatacttcttcgttcagtatctgatggccagcacatgcctttgaataattttttttccacaaactaaatttatggttagtcaagttttgccatttctacataattcctcatttatttgggtttgtttatgatacagttttcgtagaaatacttataaaaagaaattttaagccgggcgtggtggctcacacctgtaatcccagcactttgggaggccgaggtgggtgaatcacaaggtcaggagttcaagaccagcctggccaacatagtgaaaccccgtctttactaaaaatacaaaagattagctggacgtggtggtaggcacctataatcccagctactcgggaggctgaggcaggagaattatttgaacccaggaggtggaggttgtagtgagctgagatcactccactgtactccagcctgggtgacagtgcaagactctgtctcaaaaaattaaaaaaaatttaaaatgagaaaagaaattttataatttatattatcaaattagtgtgatttaatgtcagtaacacaaacagtaaaggaatgcatggtgatttatttctatggtgttttgtaggaaaggacatttgaattttctgtcaaggttatgaaaatgatctctgaaagctctcaatgattttcgttaactaaatcaataacagtaatatttaattacattcactaatggattctccttttattttatagagtcggatatttattaaataagtgcatgccagcaactatatggacaaaagacaaagcaaaatatgaaaaaggtggaaagcattatggtatgtggttgaaaacattgcttgaaagttttaaaataaccttcagagccccatctccttgtacaggctcttatttattttgcccatgaagctttattttcaaaatgaagcttgctttgcagctggcccagtgggatagcagggtttttatcttgccctttgtccctagatcaaccaagtcatctatgaatagttagtggaatcagctgagtaagatcatttgcaggtggagttgctgggagatatatatatatatatgtgtgtgtgtgtgtgtgtgtgtgtgtgtgtatgtgtgcacgcgaatttggataagtgagattttcttctaaatataatgcatactctataatcccagtggtcaatagtaatctctccacctatgtgaaggtctttgagacaagtgcacctatctttctttgtattctgtcgttgtgatccatagataccaattactctggtcttccctcattttgatctgattgctcccagttctctgtgcacgccaagcttcctctccaatatccatatgccacatgtttttcctcatccatgctattgccaaaatccatgccctctaagtgaaactttatttccatgtttctaggtcatccctattctccaacaactagattaaccacctcttctaaaaattcttccatgcttagatgaaactgatctcaccctctctgagtggttcccaagtcttagtatgcacatgtaaatgctcttcaaagctaattatgctgcagttaccaggctctgtccctagatatttggtaaaataattctgatgcatgcaatccagaaatatcttttgagaaccttcttgcataaaacttctctgagccacagtggtatttcaacttcacatcactgcaccttaaaggtagaagtattttttttttttggttcagtaccctttccctattactttaagagcactcgttcacgcattgcaagcccttgagttactcctgagagaaagaaaggagctagcaaatacttaagaaatcgagttattaaatgagtcaattttaggtttgaatataaatccacttttataaagtatgaacttggtcaagttgcttagctcttctgagccttggatatcacaactataaatgggaataataataaaaatgggaataattacttgatcataatcaaatgggaaaaaaaatcaagtgtttagtgttttattctcccttattcatgttttcaaaagagaacttcaccttgagaaaaacactcttggagtaacatgtcccatagagctacttactgattcaatatttactctccctttacattaacggaatcccaataattgagggaagcaatatgcccagttaaaatctacacaccaagcctacttttcagctagggataaccatgcgatgttggtcagtaagatgtacgtagaagtccttgggtagaaatgcagagaaaagctcttcatataagataggggatgggatgtagggataaactaaacttgtttgcaacactttgccttttgcttttctagaacatagaatatgaacataattgtttaagcagctatatcttaacttccagggaaaatctaaaagaatcacaaaatcctttgccctgatattttaatgccaccaaccatacacctataaatttcttgtcattagacaaaaataaaacaattacattggttaatctactgtttggaatgtctgttactagcattcaaatgcgatttgtaactggataaaagaaaacaaacaaacataaaacaccaaaaaacatctttcacttcttactcccactcttcaaaggaagagagtatttatttgtgagactaagaaagggcatgaattaaaatcaccaagttcctgttctcctgtgggtaggagtagatactgagtggatgaatttaatactgagagaaaactatttagaaaggtcattaggattcaagttgattcacagaattcattgcactctccaatgcagctccagtaataaagctgacattttgacccatcatcaaacctacattatacctacgttgtggggctgttgtgagcttttacgcagcattgcatataaaatgcctagtctcgcacctgatatataagtcttatcgaccatcactatgaccattcttatcactatcatcttcattttgaatattctttcttttggtaagtcacagttattctcctgctggctttaggctgctgttttaatttccctaagtctccctctagttgtgatctttggctttgatttaccctacacatttatgcacttctttttcttgcctacttggttctaatttttcctgcctctagccagttggcaaatttctccttttgatgtctatcttggcattaaataatgtttaattaatatatgtcagtgttaccaagcataccatctgaaacaaaattgccattcagccaatgtaaactgaatgtgaatcttacaaattcttgccttagcttcgtcaattcctggtcacttgagttatctccacaacccttggccacttgctgccctgaggagcatgacacattgacaggttggctgtcttcgtatcactaggactttggtgcaggtcttggttctctcattcctaacccagcctgagacattctgttcctgataataaaaaacacattttccttttatatataatattccatatcttctaatacatctgtaaaaatacttttgacctagtaatttaaagatgcttcttgtaacaccataaaaaagagaaaatattgccaaatgttgccaaaggagagaatagacagaaataaagaacagtaatgcaaatgaagcttttcatttagacttttgttaaagtggctgagaaaatattcttttggccaagaaatgtgttgttatcaacagcttccaaaattttggcctttaaaaatcatgtttacattattattattaagacatcaaacatgcaattaaataactctctctttaaatgcaataactttgccttccagaccaatgcccatcacaaatagccagccagattatgctctgtacagcttcaggagtcctcattcccatagattatgatatgaatagtggcccttgagttttacatggtagcccaagtccagcttctactcaactgatcaatgatttttaattatgttggaccatctttgttgaataggtaaaaaataaaatatagatttgaaaaaaaatagttataacatgttagaagagctttctgcaaaacataattttggaaaagtcatgtttccattgggatcaagattgtccattctattaagttaccgaaagaaacataaaaactaaaggtaaatttataccttagggggctgctgatatttaaaggttggaggtagaagagggttggacttggtggaaatcctaagaagtaacttaactgtgcaattaaagtgaactatagataaaattagaaagtgaaactaataaaaaactcttagcctgttttagaatcattcaagttattctcaacaattccacttattatttcctttaaatgtattcttttactaaatataattagttgcatacatttttgaaaacctgcaatgaatacttttttatggtaactacttaaatgccaagatttaaatttcaaaatactgattgtttccataaacaaagatataacatatttttatactctccgagtgtattttctattgccaaaatactgtgtttacaataaactttaaaaaattctcgctattttaacctttgtccactgctacgaaaaagctccaaataatactctttatgctgaagccaaggaaatgtgcgtatgctatatgagtgtcctagtgaccaggctgtgatgtgtggccttgcactctcatctacaattaaatagttcaggagtagacacatgagtcagatggattatatccaagttggcatttaaaggtcttcatttgggaatgtgcatggcaccctggaacactgaaagtgagactaggtagactagtgggtgaaaatgacagtggctgaggtgaagctctgctggtagatagggcccagaacacactcagaacaggcctcacagaggatttcgaatctttttctaagttctgtggaaaaccattgaagagctctaagtagaggaatcacacacttatatctgtttttaaaatatcaccctactgcttctggctttgagaataactggtagcagatcagcctgccagccataaactattggaaaactcgaaaaatatgtgcaacagctcttttcaggcactggaaaacagacactaaggaactgtgtttgcaatgaggagtggaacaaatgaggaatgtcctacagtcgcccaggatttctgcctggaggcacttcctagatttagacatgagcagaggaaacccaagcagggcatgccaatcatacttagctgaagagacagaaatcaaagttcagttggaggaggtgaggcagctggaatttgtagggcattgtaccagagaggagggcactatgcagtaaaagagttccagaaatctctatacagatttcctggaatctttggctgagctgtaaatgcagagaagagactacacaaagccttgcaaaacaaacaagtgccaggaaaagaacaaatcctggttggcgggagggagttggcaggagtatctccattctggacatttgggaagaacaagaatcctgctgaatatatgttgccagctgcacttaagtgtcaaccttaggaaaagagacttttgacaaaatatggtgacttactggagaccaaaacattggtatttagtgtcccttttcactagatacaccgctccccagggcattgtgagggagcagagagctgcttttcaacctccactctctcaaggacctagaaccaatctggtataagccctcaaaagtctctagttagtcacctttcctagaaatccaagaactcccatactcctgcttgaactgtgcatcataaatcccataaatgagcccagacctgaacaaacaaaagtcaggacttatttggcttatgggtatctggtaacttctgctttaaacctgcagcacaaaagcctctgaggtaaaagaccacattacggggtcccttttaaaaaatttatttttaatgatacaggaggtaaatgtaattccaacagcagtaagaacaaaatacaaattaatgtctcaataaattaatctgccacactaagtatctattttataaattcaaaccaaatgtgcttaatcatcaagggttgtatttaatatatttttttaacatgccatttgtacttctatttaattgtgatgatatgaacaggagttggaaatactgggtagaagagggcagtctacacctgtaatcccagcactttgagaggccaaggggcacggatcacctgaggtcaagagttcgagaccagcctgggcaacatggtgaaaatttgtctctactaaaaatacaaaaaataaaaattagctggacgtggtgccatatgcctgtagtcctagctactcaaggaggctgaggcagaagaatcgcttgaacccaggaggcggaggttgcagtgagccaagatcgtgccactgcactccaccctgggtgaaagagggagaatccatctcaaacgaaaaaaaaaaaaagaagaagaagagggcagttccccagcaaagcccctactctcaagcctggacacccgtggccctaaatgagaacaggcatttctgttttctctcccaaaaagttgccttttggcctgccatgtccctatcctgtatcccaggctccagaaaagaccagcagatgaggatataagacaagcagatgaacagcagaatgacacagcagagaaagagggaagagggggaatgtctgagtgctgagaggagttcggcttggggtggtcagagaggagtttagtggctgaatggtccaactccaagggaagatcatctttccactccatccccacttctggctccccatccattccactgagggccacctccaccactcaataaaaactcacattcgcttgaattcccagcactttgggaggctgaggcaggcagatcatgaggtcaggggttccagtccagcctggccaatatggtgaagcctcatctctactaaaaatacaaaaattagccaggtgtggtggcgcacacctgtaatcccagctacttgggaggctgaggcagaagaattgtttgaacccaggaggcggagattccagtgaactgagatcatgctactgtactccatcctgagcaacagagcgagactgcatctcaaaaaacaaacaaacaaacaaaaaaacctcacattcatccttcaagtccatgtgtaatccaattcttccaggacagtgggcaagagctcaggacacagaaagctgtcactctggccttctgcccttgcaaaaaggcagagagtccactgaactggttaacacttaaagccatgtgcagacagcaaggctaagacagcattgtaacactggggttgcaggcacccacccctagacactaccacagggccagagcccaaagcactggccccagcctctgcacctgcccatctgcatgctccccttcctgcaaggggtttgagcagtgatggcaactgaacaagtgagccacaaacctgttccatgtcctgcatgggggatcagggaactcttcagtttcatgatgacaagatgctctgagaagccatcatttaacccgatgcatgccggttggccttcagtttgctttaattagtttatcatcatgcttaaactggatatggagattcaaaaggaactaaggtagaaccaagcacagccaaatgaagataccctgtcataattttacaacttctgagacatcataattttacaacaaaacattggagatattttctggaccaaatcacagagaagtaaacccaaacagagcctggcagtcttcctcagctgtggagagaggtcagatttgcaagagtgggatagctggatttgtgaggcactgtcccagagaggagggagctacacagaggaagaattttagaaatcaccacagaaatccccatgagtcttttgggaccaaaagcaaacattaaaataagaataggcacacgaaaggcaggagtgcaaatacacttaacgataatcagtaatgactgtagtccctcagctacatgcttatcagtttttgtttagtattgactgttttctgtacattaaagggtgaaagaaaaagaaacattaaaaatgtgctgggtaccttctatgtgcaaaactttgaatgacagatttgattttaccatttcaaagaatagaaactagcaaacaagagtcaagatgagttgttcatatcttgcctgcagaaaaaataacgtgcttctttttgttgtagagccgaggagtctccctatgttgcccaaggtggtcttgaactcctaggctcaagggatcctcctgccttgatctctgaaagtgctgggattataggcatgagccgctgcacctggccaacaatgagcttcttaataattgttttcaatgaagacaatgaagggttgttctgaggaagatgctcacctgttctacatctcccctgcaagcaaatctaaaggcaaagagtgcagctctaaccaagtcataaggcatgccttcttgactctgaggctgtttagccacaagaactaccaagggactctaagtggggtcctgctattagaaacattaaatctaggactgaaaattgtctgtttgaaatagttatgtgctcatattaaaaaatgagaactgattaggtaaattgggagagcaaaagggcaagacaatgtctgttattgatgattttcagattgctgaattaaaatgcttatttcattcgagaagaaggatttaacagccaaaatcacacttaaccatgcatgaaaagagccactgttgaaaaatggctgataaaaatgattactcaattttaaaagcctgcattgtttaacgtaattgatgcaaactttagagaactgagtcagaattttgtaaaatgaacaagctcaatccaactaatacaagtgcagagtgccctttacaattttgaaagtaatacttgggtgtaaatgactacattggattacaagatactttaccacacaacttagaagatccttttgacatttagagcagaatgtatcaaacagcaggaatgggtaaagtgaaggacactaatacttgatctacatgttacgcttcactcttacaatgctctcatcactctttatgcaccttcttcatctacataaccaataagagtttcatataaggcagatgatgctactcgacatttggcacaggtagtacttataaataccttacaatttggcctccatctatgggattggtagaaagggcagattcatattcaaaaagtacactaactcatattaaatgtgttcagagttaggttcagtataggtatataaggcatgagtcatataaaaagtgaatgtatataaaatgctgcataagttataggaaaataatacaatgaagggtaaaatatataaactgaaactataaataaagataaactgtaatggccattaattgttagtgtacactaaattaatgtatatttataaattcatattaatagatgtacattaaattcacgtgtgtattgggggtagcgggagatcagaccagaaagggtgctagcagattgttgcaacttctttttgtttaatcatagtctctagtatcttcctctttggggggtaacaaatatattttaaaaaatcctttcatatttcattcattcagtgaatgagtttacaaaataaaattcttttcaatatgtgtttttagtcttattcataagggaaaacaaagtaggcagagagcttttcagattttaattctgtcataattacttacatgtgcaaatacatagaaaagtttagtcaaacagttaggcagctaattgtgttgaaaatacaactgcatgctcacaaagataatcaagcccctagggtgtacacttctgtttcagaactatttttaggccctcaggaacttcagccacctcttgactcctggaaaacaatgtcaaaatctaactaactgaatgtgacccagcatttatttcaaagcgacaacactaaatttgattgcaaagtaacagtaagaaattaaaagtttaaaagccagcaactgtgaatgttcaaataggaatgttcctgctatcaattttctacacatacagtgaataaattgtgttaaataaggaactgatgttcttcacagtagggaaacaaccatttattgcaaatcctaaatttgataggaaaatttactttcttttcttattctgtgtcaaaaaatatttttggaacatttaaaatgatcctgagattgcaattgtttatcactacccatgctaaaatagatacattaaggtgttaaggacctaaagaatttagaaatgtccttcaggggaaaaattcctgaaatttcattgtacatgtggcatatatttctttgccattgtcgttcaaattttgcattctagaatcaattaccctatcaattttccctcaaaaatattatctctaatcttattctctccctttaaaaatcttcaagtgcaattcttaggaccctataatatgattattaaaattttttccattgtgtatattgatatttagaaagagagtgtgaaaagaattgtgattggcttttaaataaattttcttaaaactgtatcatgaataatttgccataatttacattttatgtgtcaatttataaacactatgtatttgtttctcattttattatgtcaccttgcattataactaagatgttatctctgcttgtttcttaacttcaatcattttatgagagaaataccagttacttactcaggaaagatgatttgaaacatggaaaagaaaattatttcccatgagggaatgtcaataatgggaatctaacatcaccattcttttaatatttaatagatagccattcttttaatattgacattgtgccatgctaatattatttcaagtgtgatctctgccaaaaggtaggtgtctagggggtaagaatcaataatgacaacaatcttttatttgtaggcctactaagtgttacacattgtgctgacagcttttagcatattgtattcaatcttgataagaaagcttcaaggtgagcattattattgtcatgttataaatggcaaaacagggcttagatcattttcccaagttataaacctagtaagtagcagatgtgagattcaaacctagggatacatcatatttaaatgttagattaagtagtatcaagtggcagctaagacaagacacctgagcatgctgaagggtacctagctgtgatgttattgtgctcctctaccattataagtcattctgaatccttgtcaattcaactctttatttactgggaaaattctcacttttccttctaaaatcagtgcagctcagacttgtccatagagaagtctttcttgatgatcacaggatttctttcctgaaatctcacggtccattttattacttaagtctgtgtattactcaggttctccatagaaacagaaccattttatgtgtatataaatgaggaatgacccatgcaattatggaggctgagaagcccacaatatgccttctgcaggctggagacccactaaatctggtcgtataatttaacctgcatctgaaggcctgagaacccaggagaaccaataatgtaagtttcagtccaagggcaggagaaatgtgatgagacattccagctcaagcagtgaagcaggaaaaagagggataaattcatacacatacacacacacacatatatacatatatatatatatatatatatacacacacacatataaatataattttttttttttgagatggagtttcactcttgttgcccaggctggagtgcaatgtcacgatctcggctcactgcaacctctgcctccggaattcaagcaattctccggcctcagcctctcgagtagctgggattacaggtgtgtgccatcacactctgctaatttttgtattattagtagagatggggtttcaccatatcggccaggctggtatcgaacccctgacctcaggtgatacacccacctcagcctcctaaagtgctgggattacggggtgagccacggcgcccagccaaagagggatgaattcttacttcctctgccttttgctctattctgggacctcaatagattggatgataccaatcactttggcaggggtgattgtgggccttgcaatctactatactgagtcactgattcaaatgcaaatctcagccagaagcacccttacagtgtaacaccccaaaacaatgtttctcctgggcaccctgtggcctactcaaatgaacgcataaaattaactgtcacagtctataatggagtataacatgcggcactgcctggtacaccagtcttcagctctgtcattagaaaccctagggcttgaacatgtttcagggaaaaaaaaaaaaacctactacaaaagtactatcgtatgtcaaaataaaatgaaagaatgaacgaacagttgaacaatgggcgaatgagtgaatgtgcatcacacatagctggacgagaaaaatttaatacttttttttctcacagaaatagagttatatcaaatatacttgaatagtttctagtgttttcagactgaaaaattaatttcaaagaaactttatttactttatataataccctgtaagtcatgaagctcaagtaattggactgtaaattaaattactgagttacaaggacccatattacaagctattcctcctgctgtttttcatcagaaacgttcatatgatattgtggaattgaatttttaccatcaaataaatattgcatgcttggttaaatgggacatgattccaagctcaaaaaataaaatatagaacaggcaattcactggtcagttgtgaaatatgaaaaagaagtaagcacatatttcttttttttattatactgtaagttttagggtacatgtgcacaaggtaaaagtttgttacatatgtatacttgtgccatgttggtgtgctgcatccattaactcgtcatttaacattaggtatatctcctaatgctatccctccccccctctccccaccccacaacaggccccggtgtgtgatgttccccttcctgtgtccctgtgttctcattgttcaattcctacctatgagtgagaacatgcagtgtttggttttttgtccttgccatagtttgctaagaatgatggtttccagcttcatccatgtccctgcaaaggacatgaactcatcctgttttatggctgcatagtattccatggtgtatatgtgccacatttatcttaatccagtctatcattgttggacatttgggttggttccaagtctttgctattgggaatagtgccacagtaaacatacgtgtgcatgtgtctttatagcagcatgttttataatcctctgggtatacacccagcaatgggatggctgggtcaaatggtatttctagttctagattcctgaggaatcaccacgctgacttccacaatggttgaactagtttacagtcccaccaacagtgtaaaagtgttcctattcctccacatcctctccagcacctgtagtttcctgactttttaatgatcaccattctaactggtgtgagatggtatctcattgtggttttcatttgcatttctctgatggccagtgatgatgagcattttttcatgtgtttttcggctgcataaatgtcttcttttgagaagtgtctgttcatatcctttgcccactttttgatggggtggtttgttttttgcttgtaaatttgagttctttgaagattctggatattagccctttgtcagatgagtagatggcaaaaattttctcccattctgtaggttgcctgttcactctgatggtagtttcttttgctgtgcagaagctctttagtttaattagatcccatttgtcaattttgcttttgttgccattgcttttggtgtcttagacatgaagtccttgcccatacctatgtcctgaatggtattgcctaggttttcttctagggtttttatggttttaggtctaacgtttaagtttttaatcaagcttgaattaatttgtgtataaggtgtaaggaagggatccagttttagctttctacatatggctagccagttttcccagcaccatttattaaatatggactcctttccccattgtttgtttttttttttttttttttttttttttttgagacggagttttgctctgtcgcccaggctggagtgcagtggcgcgatctcgactcactgcaagctccgcctcccgggttcacgccattctcctgcctcagcctcccgtgtagctgggactacaggcgcgcaccaccatgcccggctaatttttgtatttttagtagagacggggtttcaccatgttagccaggacccattgcttgtttttgtcaggtttgtcaaatatcagatagttgtagatatgcagcattatttctgagggctctgttctgttccattggtctatatcttcgttttggtaccagtaccatgctgttttggttactgtagccttgtagtatagtttgaagtcaggtagcgtgatgcctctggctttgttcttttggcttaggattgacttggcaatgcgggctcttttttgcttccatatgaactttaaagtagttttttccaattctgtgaagaaagtcattggtagcttgatggggatggcattgaatctataaattaccttgggcagcatggccattttcacgatattgattcttcctacccatgagcatggaatgttcttccatttgtttgtatcgtcttttatttggattcctaggtattttattctctttgaagcaattgtgaatgggagttcactcatgatttggctctctgtttgtctgttattggtgtataagaatgcttgtgatttttgcgcattgattttgtatcctgagactttgctgaagttgcctatcagcttaaggagattgtgggctgagacaatggggttttctagatatacaatcatgtcatctgcaaacagggacaatttgacttcctcttttcctaattgaataccctttatttccttctcctgcctgattgccctggccagagctcccaacactatgttgaataggagtggtgagagagggtatccctgtcttgtgccagttttcaaagggaatgcttccagtttttgcccattgagtatgatattggctgtgggtttgtcatagatacctctttttattttgagataatttattgagagtttttagcatgaagggtgtagattttgtcaaaggccttttctgcatctattgagataatcatgtggtttttgtcattggttctgtttatacactggattacgtttattgatttgtgtgtgttgaaccagcctttcatccccggcatgaagcccacttgatcatggtggataagctttttgatgtgttactgtatttggtttgccagtattttattgagaatttttgcatcgatgttcatcagggatattggtctaaaattctctttttttgtagtgtctctgccaggctttggtatcaggatgatgctggcctcataaaatgagttagggaggattccctctttttctattgattcgaatagtttcagaaggaatggtaccagctcctccttgtacctctggtagaattcggctgtgaatccatctggtcctggactttttttggttggtaagctattaattattgcttcaatttcagagcctgttattggtctattctgaaattcaacttcttcctggtttagtcttgggagggtgtatgtgtctaggaatttatccatttctttgagattttctagtttatttgtgtagaggtgtttatagtattctctgatggtagtttgtatttctgtgggatcggtggtgatatcccctttatcattttttattgaatctatttgattcttctctcttttcttctttattagtcttgctagcggcctatcaattttgttgatcttttaaaaaaaaccagctcctggattcattgattttttgaagggttttttgtgtctctatctacttcagttctgctctgatcttagttatttcttgccttctggtagtttttgaatgtgtttgctcttgcttctctagttcttttcattgtgatgttagggtgtcaattttagatctttcctgctttctcttgtgggcctttagtgttataaatttccctctacacacttctttgaatgtgtcccagagattctggtatgttgtgtctttgttctcgttggtttcaaggaatatctttatttctgccttcatttcgttatgtacccagtagtcattcaggagcaggttgtttagtttccatgtagttgagtggttttgagtgagtttcttaatgctgagttcgagtttgattgcactgtggtctgagagacagttttttacaatttctgttcttttacatttgctgaggagtgctttacttccaactatgtggtcaattttggaataggtgtggtgtggtgctgaaaagaatgtatattctgttgatttgaggtggagagttctgtagatgtctattaggtctgcttggtgcagagctgagttcaattcctggatatccttgttaactttctgtctcgttgatctgtctaatgttgacagtggggtgttaaagtctcccattattattgtgtgggagtctaagtctctttgtaggtctctagggacttgctttatgaatctgggtgctcctgtatgtggtgtatatatatttaggatagttagctcttcttgttgaattgatccctttaacattatgtaatggccgtctttatctcttttgatctttgtcggtttaaagtctgttttatcagagactaggattgcaacccctacctttttttgttttccatttgcttggtagatcttcctccatccctttattttgagcccatgtgtgtctctgcatgtgagatgggtttcctgaatacagcacactgatgggtcttgagtctttatccagtttgccagtctgtcttttaattggagcatttagcccatttacatttaaggttaaaattgttatgtgtgaatttgatcctgtcattgtgatgttagctggttattttgctcgttagttgatgtagtttcttcctagcctcgatagtctttacaatttggcatgtttttgcagtggctggtaccggttgttcctttccatgtgtagtgcttccttcaggagctctgtttgtcaccaccaggcctggtggtgacaaaatctctcagtgtttgcttgtctgtaaagtattttatttctccttcacttatgaagcttagtttggctggatgtgaaattctgggttgaaaattcttttctttaataatgttgaatattggcccccactctcttctggcttgtagagtttctgccgagaggtcagctgtaagtctgatgggcttccctttgtgggtaacccgacttttctctctggctgcccttaacattttttccttcatttcaactttggtgaatctgacaattatgtgtcttggagttgctcttctcgaggagtatctttgtggcattctctgtatttcctgaatttgaatgttggcctgccttgctagattggggaagttctcctggataatatcttgcagtgttttccaacttggttccattctccccatcactttcaggtacaccaatcagacgtagatttggtctttcacatagttccatatttcttggaggctttgtttgtttctttttattcttttttctgtaaacttctcttctcgcttcattttattcatttgatcttacatcactgataccctttcttccagttgatcgaatcggctactgaggcttatgcatttgtcatgtagttctcgtgccatggttttcagcatcatcaggtcctttaaggacttctctgcattggttattctagttagccatttgtcaaattttttttcaaggtttttaacttctttgctatgggttcgaacttcctcctttagctcagagtagtttgattgtctgaagctgtcttctctcaactcgtcaaagtcattctctgtccacctttgttccattgctggtgaggagctgcattcctttggaggaggagaggcactctgatttttagtgtttccagtttttctgctttgttttttccccatctttgtggttttatctacctttggtctttgatgatggtgacgtacagatggtgttttggtgtggatgtcctttctgtttgttagttttccttctaacagtcaggaccctcagctgcagatctgttggagtttgctggaggtccactccagaccctctttgcctgggtatcagcagcagaagctgcagaacagtggatattggtgaacagcaaatgttgctgcctgattgttcctctggaagttttgtcccagaggagtacccggccatgtgaagtgtcagtctgcccctactttggggtgcctcccagttaggctactcgggggtcagggacccacttgaggaggtagtctgtccgttctcagatctccagctgcgtgctgggagaaccactactctctttaaacctgtcagacagggacatttaagtctgcagaggtttctgctgccttttgtttggctatgccctgccctcagaggtggagtctacagaggcaggcaggtctccttgagctgtggtgggctccacccagtttgagcttcccagccgctttgtttacctactcaagcctgggcaatggcggggtgcccctcctccagccttgctgctgccttgcagtttgatctcagcctgctgtgctagcaatgagcgaggctccgtgcttgtaggaccctccaagacaggtgcgggatataatctcctggtgtgctatttgctaagaccattggaaaagcgcagtattagggtgggagtgacccgattttccaggtgccgtctgtcacccctttctttgactaggaaacggaattccctgaccccttgtgcttcccgggtgaggcaatgcctcaccctgcttcggctcatgctcggtgcacagcacccactgtcctgcacccactgtccgacaatccccagtgagatgaacctggtacctcagttggaaatgcagaaatcacccatcttctgcatcacccatgctgggagctgtagactggaggtgttcctatccggccatcttagctccacccccagcacatatttcttcttacctaatttgattacccaaaattttgccaccgtttgtctagtcatttaataataactttggaatctttgcttatgtaaaaagaattgcaaagagttaataacctctctatcctccaggaattattgcatagtttaagacattccttattaacatcccacaagaatttcccagtggcccacaatagtctttcttcacacaatattttttgtaacattgtctattctataattcattatttttataatttgattatgttttctaatattccaaaaatttcacatctacttactttccaataatttttttcaaaattaagtccaaaatcattcacactgaatatagtgctgagtataaacagggcctaattaattgggttgaaaaattctctcatagctcttatagcaatgcttctcaaagagtggtccagggcctccaggggggccttgagaacccatcagaagatctgtaaagtcaaactatttttgtaataatactaagaccttatttgtctttttcactgttaggctctcatgagttaactgtggatttttttccagaggctgcatgaagtgcagtataacagattgactgcagaagcagagaggaaaacccagatgttttctattgagccaaatcattaaatagatttgggaaatgtaaaaaaatgctactcttctcattattttgtttctaaacatatatttatttttcataaaaatattgtttatgttaacttctaatgggtttatcatagttattggaaaaattaatttgtaaacaaatttttaaaaaatatgtcagttttagtatctaatacagaaaatatcaataaatttaatctgcatacgaaggctttttgtagtcttcaataatttttaagagtgtaaaggagtcctgagaccaaagagtcttagaattactacttttaagcatctcaaacggataagtacagatacacttatttggaagaatagcaactactatttactgcatttgtccaaccagctggccactttatacacattacatcatttaatcctccacagtgctatgagccagatattgtgctcctctctttttgggaaagaaatctgtggctcaggatgatcaggatgttcctctaaggtgataagaggaagcactggactttgaaccaggtctgactacgttcaaacttcagattcttaatcattaccctggctcagtctcaaaaaagatttaaaaacttgttgcatgagcacatgaaaagctgatcaacatcaaaagtaattaaggcaatacaaactaaaaccctaatgagatgtcatttcatagccactaaggtggtcataataaataatctagacaataataaatatgaacaagaatgtaaagaaatgaagaaaccttatacatcactgatgggaatataaaatggtgcagccactttggaaaacagtatggcagttctgaaagtggaatatatatgtgagttaccacatgacccagcaatttcattcctaggtatctatataagataaagataaatgaagctatgcatagcctaggtatccatagctaagacaaataaagtatatgttcatgtaaagacttgtagagaaatgttgataacagcattatttataagagcctaaaaatagaaataaccctaaatgttcatcagtttaagaatagataacataaaatgtggtatatctgcacaatggactattattcagccataaaaaggaatgaagttttgatatatgctacaccaaggatggacctcaaaacattttgctaagtgagagacgccagtcacaaaggaccacatgttgcataattcgattatataagatgtcatagaaaggcaaatttaaactcaccaaaagtagataattggttgcctgggcctggaggtcggaaggattaatagcaaatagacataagagttcttattgtggtcatgaaaatgctcaaaaactgacttatggtgatagttgcacagctcagtaaatatactaaacatcactaacttttattcttgaaatgggtgaatatgatacacagaataagcctcaaaaagtgcttaggccatttggaaagatctctttttaacagttactgaaggaacatacagtagttaaagaaataacatagtaattaagtgatagtaaagaaaaagctgaaaacttggtgactgaaagcttaatagagattagggagtcagtgcaagaataagatcaacacagaataaacaggggaatgaaaacctaaagagaaaagagcaaggaaggatgagacaaagatcagggaggcaggttgttaactgtgatttcacagttctaaaaggaagttggaactgagcagattagaacagtctttgtccaaagcaatgtgaaaatagacatcaagacccttaatttttctttcctttgacccaaggatttatactgtgaaaatttatcctaaggaaattatcttaactacagaagaaaatgttacgcatgaaataattttaaaaaataaatccttgccattgtttacagtgtaaaaactaaagaatacctaaattctttaagaaaaatagtgaagtaaatcactacattcacatagtgaactattaaacaataattaaattgatgttaccaatgagattgtgttcagtatcttcatctgtaaaggcgataatattagcatctagctctaccaacaaaaatctatgtattttttgttgagagaattaaatgtagctaacacatatgaaacatgtgcattcttaaacacagtgagcaacacatggtaagcgattatttaaaattaatctctgttattaattgacagaaactgacacatgggagaatcaataagggattagagtaaaacaatttagctagctattaaaagaacaataatttttaaatcatttatttattccaaagcaaaggagagaaaaatatggtacttttgtgaatatctaaatcaaactttaatttctatattataaacataaaagtctgattgttaaatcttagaaatctttcataaatcagcagaggtaataggttcaccaattatgaaatttcttctttgagaagattaaaagaagaaattgggaaagagaaataaacaattataagctaaaataaaaagatagataaagacagtaaaggaaagattttaaaagctcagccagggttaattcttatgtcctacttggtttcctaacccccaaattccttttatttctacagacagggttacagatagttcctgctacttgagtgccgtctaatgtcccaattcctatctttcctgtagtgaaaagggaattttaaaaatcagttctcagaagggtcagagttgatttaatcttattcataatccagctctgaccttgtgttaattctagtaactagacttctggtttacctatgagattaagtcaccattttctacttcatttcaataattgaattctttattgtcagatttcttgagtggctccctgcttctaatacccataatttgctggatttatcttgctagaatcccatggatctcatctttgaaatacagccgagtggatggagccttgcagacatccctcatgcatgatacttatttgacttcataattaataatacatgtactaatgttacccaggattgtacacacctgttacatattaataaaaaaggacagggttatatttgtgggtcttggttgacacttagagcttgcctaaattgtcatctcttgcctgtcaccatatactcaagaaactcaacttcccttgcctgactagctttcttgacttacaatataggttgttacatctccaaaacaatacttatagcatccaaaaagtcacattcagtataaaaagtgtcaactctactactgaatttttccattgcagataccaattctatgtcaagttccagagataaaaattgagaatcagagagtcagagaggtcaaggagacacagctaatcccttgggtggttatacctaaaaacctaaaatctaaactctaatttagagatggtagagctgtttgtttgttttacgtactccactagacagatagtatagagtgtatatatgtttagaaattttctatatttgttttaaatattactatgtctgaagacaggaaggagcctatactatttacatgattctattctaataagattcattactactaaccctatttaacagttattaagcaattgcagtaattatggttattcatatttcaatacatgaaatattattaaagatagtgtcttaaataatatctcatatttatcatttgatgagaaattttaaatacattattagatttaattttcgtaaccatcctgagagatatacggatgagatattcttacccctgtttaatagataaataaaatgtggcgaaaaaaaggtgaagtaatatccaaaggtaacattatttttattttaggtataatttgaactcagatctgcagactcgatatatagtgttggtagtaaaaattatgctcctgtctctataatgtatttttaatggaattttagaagttagcattatgctaaatggaatcagattaagaaacatacctctgtctaacattgaaacagactccaaatgtctttataatgggcaagtggatacagattaagtgccatgaactatcatcatcctaagagtcttacttcctttcatggtgattgtcagggatgcttttctgagattcaaatattctcatggatgagttaaaagaagatgaaacaagatgataaaaccagtctcttttcaagaaaccataaacatgttagcaaccatcaaatttctttacgccctcattctagtaaattataagctatcaaaactgcacacgttctgaaagtttactaaatgcaaataaaatagtctctttgccatgctgtaacttgagataataaaggacttaaataaattcagtgaaagcaaaaccccatatgtttgggtgtcagaggctactttgactaagctcatttcaaattataacatcagcaaaattaagctattaaaactacaaataaaagagtatttttagttctaagaagaaataggactaattggatacacatatgcctcctaggctgtatatcttaaatgtgaggctcatcagtagttattattaaagttggcagaaataatggacatagtaaattgtactttagatttttctttatgcacaattgcttggtgttatcttcttaattgagtcacagaataaaatctaagaaaacagatgtaaacacacagacattaaaatgcatcactacttttgcctttaccttttcatattggttttcgaagtgatgcatggttaaatgaacctaatttgagagaaatttggagatggccgctgagtctgtgtgctggtcagggggttgctttctactgttgatattattctttgcgtattaacctcagaaggggaacaatatatggaaatgggatagaaagtcttcagaaaccacagtaggaagattaatattcatagcacatttatgaagtaggcatcattatgtgtgtgtgtgtatatatatatatatattcacatatatataatttttgaaaaattattttacagataatgagtttgagatacaaggatggtttataacttacacaagatcacacagatttcaatattctaattctaattcaattttttctaattcttagttgcatgtgttagtccttatctaggtcttagaaaattacacttcttttttgcaatagtccaaatagtctaaaccgtacttagcatttagtgttcaaccaagtttcttgactatgtcagtaaaatgtgctggctttaaacgctgggatcatgtcatcatcactgtttcctcagagcccaacaaaatgcctggcacatatcaggaacttcataaagagcattaaatgaatagataattgaggacatgaaaaatacatccatttattcatttagaaaactgtgtgtatttataaatgacagcattccaagtcacacatatttaaacttatgaaatttctagatggtttaaatttataattaatgtaaaaatgaggaaggacagagaaaacattctttgtatgcaaatattattatcttctacatagtcaataagattttagaaaacaatgttgcatagaacatatgaaatatcaattgcttactattattgtcaataaaggagagcttctcttatataacattcattataaacatctgtgtgtaaggaaagaaattagttttgtgctataaatattggtcatataattcattaattccttcatttattcactaagaggaatggactactttaggtaatgttgtaatataagccacatcacaggatcctttatttctcttcttcaatattctgaatttattccttaatattcaataatttttggaagatattatctttgtcgtattatttgttcaatgacaactatatgtaaagaattatttggaatatttgctgattgaaaactatgtgcaaagggcagtaagaatcttttcattgttttatttaattctcaacaaatataacatgaggtcaccatttcacatatatgaatactgaagttcagaaagtttaagcactttgcctaaagatgcaaaaccagtcattggcagagtttaaagtctctggcacattgacaagccctctcaatgtggagaaaaaggaactcataagctgttggtgggaacgtaaactagtacagccactatggagaagggtatggaagttcctcaaaaagctacaaataggaccccaatatgatccagcaatcctggtactggtaatttatccaaaagaaattaaatcattatatcaaagagacacctgcactctcatgtttattgtgtcattaatcacaacaggcaagacatgaaatcaacctaggtgtctaacaacagatgaatgaataaagaaaatgtgacacatatacacaatggaatactatttagccataaaaagaatgaaatcctgtctttcacagtggatagaattggaggattaggacattatgttgcgtgaaataagccaagaacaaaaagttaaacaccacactttcttactcaaatgtggaagttaaaaaaaaaaagttgatctcatagaagtaaaagaacagaggatactggggctgggaaaggtcaggggaagggagtgatagggagagatttattagaggatacaaaattccagctagataggaggagtaagttctagtgctctataccactctaggatgactctagttaacaataatatatagtttcaaatagctagaagtggatatttaatgttcccaacacaaagaaacgataaatctttgagatgatggatatgctaattaccctgtgcattactatacattatatgtatcgaatcatcactatgtactcataagtatgtgcaattattatttgtcaattaaataaatttaaaaagacaagccctctcaatcttcaaattctataatttttactcttcctctaaatctctataaaattgattgtaggctgggcataggggctcatgcctgtaatctgagcactttgggagggtgagactggcagatcacctgaggtcaggagttcgagatcagcttgaccaacatggtgaaaccctgtctctactaaaaatacaaaaattaaccagacgtggtggcggttgcctgtaatcctagctactcaggaggctgaggcaggagaatcacttgaaccccagaggcagaggttgtagtgagccgagatcgcaccattgcactccagcctgggggacagggcgagactccatctcaaaaaaaaaaaaaattgactgcaatgtgtttttgttgttgttgttgtttgtttgtttgagaaagagtctcgctcttgtcacccaggctggagtgcagtggcgtgatctcagctcactgcaacctccgtctcccgggttcaaacgattctcctgcctcagcctcctgagtagctgggattacaggcatgtgccaccatgcccggctcatttttgtatttgtagtagagacagggtttcactatattggccaggctggtctcgaactcctgacctcaggtgatccgtcggctttggccaaccaaagtgctgggattacaggtgtgagccactgggcccagcctgtagtgtgtatttttgtatgtttctaattttaaaaatcaaaaattgaaattcctgccactgtttacttaaataaacctaaattagataccactacccttatgatctaaagtcttctctctatggtcccaaacagtctctttatgaaagtttatgatttctatagaaggaaacatccttcagacgaactgaccaatggtactggcaatagaggcatctgatttagaaagccagttggtataaatatggccttatcatattcctgccttcctggttctagaatccccagtgtatacaaatctaaacatgaatgctttcttgcccacaagtataaagcaaaaaatgtttcctttctggaacctaaaggtatacaaaaattctagtccttcattaactatatttaatttaataattaaggaaacatattaaaaagctaagccacaggtaatttcaaaataggggagagtaaaactcaggaaagagaggagcaagacttatctttattaaaggtttatcataaattagaaaaaatatggcatagtctttatattttcaggcatagaaattttgccggcattctgaactacaaatgctgctgttaagataattttgtcactaaacaacaatatgtgatgggaacaaagcaagatgccaggagatacaataaaggctagaatgtagtttatagcaaatttggcccactgcagtggaattggtaaatggcttctggaaaatgtatagcatcataaaaaaccccaaagccatgtttcctctgaaaaatgttaaacaaaggtttcaaacataaaaatgctcatttccatattgattttgatgaccagcgttaaatcaggcagtgtgaatggctgatggactctgctcctctgtgtcattattctaccatttcattctgaagggaattactgtatagatggcagtttgaaacaattttcaagcctctagatagagggttttattttttttctctaaataaatgtaaacaattcttttctgagaataactgtacccaaagaaggtggaaacttgggaattcagtatgattttaaagaataaaggtgttatttcacttgggtaagtattatttggttgaattcttcatgatatagcaaaataatttttgaaaagtccctttttataatgacaagctatgcatacatttctgaaagcagcagaaagtttctgaatcatcttgaaatatcccacatctgaaataatggcgtggtggctcacacctgtaatcccagcactttgggaggccaaggcgggtggatcacctgaggtcaggagtttgagaccagcctgaccagtatggtgaaaccccgttctctactaaaaatacaaaacttagctgggagtggtggtgtgcacctatagtcccagctactggggaggccgagacaggagaattgcttgaatctgggagacagaggttgcagtgagccgagatcgcaccactgcactccagcctgggcaacagagagagactccatctcaaaaaaaaaaaaaaaaaaaagaatatttagttggaaaccattgccttctgttctcatgttagaaagaatgtggaatacatcctccaatttgttgtaatataggaaattaaattgaatagtaagtatgtgtgtgtgtatatatatatatatatatatatatatatatatatagagagagagagagagagagagagagagagagagagagagaaagagagacagagacagagtcttgccctgtcaccaggctggagtggagtggcatgatctcggctcactgcaacccacgcctcctgagttcaagcaattatcctgcgtcagcctcctgagtagctgggactacacacatgcaccaccatgctcggctaagttttgtatttttagtaaagacggggcttcaccatgttggcctggatggtcttgatcttttgacctcgtgatctgcctgcctcggcctcccaaagtgttgggattacaggcgtgagccaccgcacctggccaaatagtaaatatattcataacaattaaaaacacttgtttggtaactgctctcacaacataaattttgtatgaccagtaatgactggattagagacttttgcttgcagctatatggtaggatagacaattctaattacttgatcctaataacttacttaattacctaataacttacatgaaacgttatttttatcacatttctgggctctcagtaagtaaagagactcattgaaggtgttaggttggggaaagagttgtaaccaagtgtgaaagacattgggcatctagacttgagtggaaaaattgaggtgatgagattaagaatcttgattatacttgggaccctggaatggggctaatgtggtctgagatctgcagatgtgaatataaatcttcggtagaaaaaaaaaatgcctcacaaaaagcagcaaacaacaaatatcagatttacatcctgaaaaaaattcatgtactagagtgatctaatatagtatttctctttctttgtctatagatagagatatggaatcataaaatcagaaaacaaaaataatcatcaggcaaattcaataaatagtagaaaaaaatatacatgtcatttcctatgggccaaacattttataagtttcaatacattaaatgatttaattctctagttattgtctaaggtaataacaatttccatatttccattttatttatgaaaagattgaaattaaaggaagttttatgtcttattaagagccaaacaggctggatgccatggctcacacctgtaatccaagcactttgggaggccaaggcgggaagattgcttgaggccaggagttcaagaccagctggggcaagatttttgtgagattccgtctctacaaaacattttaaaaatgagtcaggtatggtggccacatctgcggttccagctattcaggaggcttaggtaggaggattgcttgagcccagaaggtagaggccacagtaagctgtgatcctgccactgtactcttgcctgagtgacagagtgagaacctatcttaaaaaaaaaagcagacagcaagaatctaccaaatatctaaaattgaagaaatatatatgtttaaaaaaagttaacaaatggatgaatcatcatatcatacacaactgaagaaaagattagtgaattggaaaagttatctgcagaaattatctggattacagtacagtgaaacaaaggcctggaaatacataaatctgaataaagaatatggtggatagaatgagactacccatcatgtatactgtcacatgctcaggacgagataatcgagataatagaataaatgacatatttgaatagaaaatagctaggaactttctgaaacttgttagagacatgagttcacaaacaggaggcaatgatatatacctccaaaacagtataaataaaaatgaatccgcacttagacacaccttagtgaaactacagaataacaaagacaaaaaacaaccttaagaatactaagaataccaaatcatgaaagacaatcaggttggcatcagattcagaaaggaatcctgactcttaagcctcttctcttcctgtctactctttcttcagtctttcttgcaaaaatgaaacacaataacttcatcttagataaaatatgatgttagcattaattagtctatatatttttatcagtcttagaatagtggctaaaagaacaggctttgaacagcagatttgcattttgctatcaaccctataatttaattagccgattattagcttaaatataatcaattcacataatcccactgagactccatttcctcatctgtacaatgcatattattccatgtactgcatagtatggttgtgggattgagtgtgataatgtatatacaatttagcattcttcttggaatgtataaaacaatacagggaaactatcaggttgaatcatatgaaattatcttgtaggtcaaaaaagttgaatatcagtcatttcacttgggtcaacttaatagtaaattgtggtttcaagttgagaaagaatcaagtttacttttaaattcatatacaaaaagagacatacattttaataaggaaaagaagctagtttacaatcaatcttgcctcctacaccattatagtctgtaggttttactctacgagtgtccgcttgttgatgatgtgatgtaatctaccagaatctgacttgaatagaatatttaataagttgataatcatataactacttttatgattagaccatgtattggctgctcaaataacaaaatttcctggtgcttctactggtaccaggggatttatggtttaggcataagatttaggcttgcattttattgtgactattctaaatatttctctgatgtgtcaggtagtcctttaaggtggccaccatgaccctttcttcctgagtttgtgacttgtttgtaacaaacagaaaacggaaaagttgatgggatatatttgattacatgttcgttacttcacaattcgttacataagattatatttcttgtcctgatggagtctctctcttccttgatggcattcagaagacaagcaactttgttggggaaatcatacagcaaaacctgtgggcagcctctaggagctgacagtggcttttggcagatacaaagaagaaactgaagccctcactcctacaaccacagggaactgaattccgccaacaacctgaatgagcttgaaaaagcctcaaatgaatccacagccctgtctgacaccttgattgctttctaagactccaatcagagaacacaactccaatcagaggacacagtaagccatgcctggatttctgacacacaaaaacccacatgtgagtattgttttaagctgagaactttgttgaaatattaataggcaacaatgattaacaaatatacctggaaaataaagagctatcatcagagagtggctcatgaaggaaaagaaaaagcaggttattctttccaaagccattcacaaatttcacaactacgctaacttttctattttgaaacagttgcaatcttaagaaaattgaattatcaggatgatctttaaaagtaatcatttccatgagaaaaatacccaaagagattcaaaatccagagagtatgacatgtgcagtaacaagtttgagagttttttttgtacaagaataatgttgaaataaggtggttttatggtcataagtacagtttttaaactgcaactttaccattaaatggcttaatcaaaactaaccaaaacaaatatactcatcatttactcttcagaatatcacatacctagcttctcagtcaccccatcaccaatggctttgatcctgcagttttctttagaggcagtttacagagccaaagaaaaacaaatgagtggaccattactaatactcttcaactgcacaggaatcacatttcctctattatagcaacgtaacacattggtgatataaagttatatcattcagtgtaaaggattattctgtgatttttagtatatattgttctagatagcaggcataaattgggtactttgttgagaatctgctgcccaagttaactgcaatatcctctttcgttaaatacttcaaagtgtcttaattggctcttctgtgaacattctgggctactcactgaaagacacataagactatacatggaagcaagaatcttagaggaagcattcaggacagagaagggaaaggaagcttgctttttgctgtcactgcctaggcaaatgatagagcttcaatttgctctgagaaagagaaattttgattatactttttagcatttgtccacaaacaagaagcaaaacttagaaatatgttcttttcccaatcaaaaatagaatgttgaacgaatttatctgagtaagggcaagagatacatttcctgactccatagtcaatgaacacaaaataaatcaaaacgtagctccagaaaaaaaaaattggggaagaaattcccacatcttattgaaaaatgatgggaaattggaaaggggctcctgaaaaaaaaaaaagcctggagaaattgctgaagggtcaattgggaaaatgcttattttcctcttatttcagggcaacacatgacagaatcaatgtcatctcaagagattccagtagctgaatggtttatttacatattaaacacaagttggaggaatgagtttggtctttgagtatcctgaattttacactatttacacatcccctcttgaggttttacttagtgtactgtaaaggcaaacaaagccttgtctatccacagaaggactcctccagatcctatgggaaagatccaagagctttgttaaacaccaaatagtctttaaataacaatcttctgataacttgatagtaaacagccatactttagtgatttcctagtaaacataaattaatatactatatcagattatttggaaagatcattattttctttgaaaataaaacaaaaacaaaaacaaaagtctgtaattttgtgcacagacccaacaatctcatttcccatttatgacagaattcagtgaatcatgcttctacaacacattctgcttcagggcacacatctaaaaattaatctttctgaggatacagtaatcatgaccactccggtgtcaattactgtgtatggagaatgtactatgtgccaagtgctctgctatttcattcaatatgtagaaggttattacaacaacccatgaggttgctgtaagtatttcctctaatttttcagataagaagacttgggctgagagaagttaaataacttacctacaatatcagaataaagttgggatttgaatgcagacaatctgattcctgagtaccattgttaaatagcagatattaaaaaaaatgtgagtcagtgttagaaactgaataatatcatcttacatttattcaggaacatttaacaatatgattgcttaatgagattcataattttactgcaatcaaatgctgcaaaactcaactcctgaattagatttacggtatgctgcaagtagatggttaaaaacatgatcacattgtagatatttacaaaaataaatgaataaaaataaaaatttgcactatcatgtttagtagcatggagaatttggtatgggaaggtcaagacaacttcctagtttgatgagttttgtaagatatttcctaattaagtgtgtgaaattttcatcatgtaatattaaagatctctcatatacaattctgcacaaaaagaggtctgaaaatctgaattattttatagtacaaataacacaaatgtagttgaaattagcaaatgtttagtgactattatatgccattaagtatatcaatttcacatgcatccaaactttaattttactgtccaggaggtgacaatatataataataaaaataataataattttaagagtcatgaagtaagtactatatgccagaatgaaagggagaagcactaaagagatggaagatttcattctgacttagttaagatggattcctagagcagatgtcacttggatgggtttttaaatagtagaatttcaacaagcaagcaagaaggtatcaaatggaaggaatatttcattatacttagtaggtaacaaggccccagcagtcagactgaagactcaaacatacatgggctctttggggctaccctccctccttgtatctcatttcataaattgattttcaggcagagcctctttagtggggaaggaacatacacaatgaactattgtgatcaaaacatagacaaatgtgcatgacaaattggtagagataggaggaaccaaatattgaaggaagatagagatagttttccaagaacattcataataaaggaagaggactagcagtaggaagcaaatacaacaaatggggtctgaaagatgaaggaaaacagtggttctcagcactgcattgcgatagggccttgaactcagctaaacccatctagcctaacaccattgtatactttggagtgaaaaagggctgtataataaattgtgtcattaaatgtggccaataatcctatcatgaaattcccctaattggcacagagactctcacttcttaaggtgccattgagttgttttaactgtgaacatagggatgaaatgaaaagagagaagcaaatcacgtaaagatacttaacaatataattccattttataaatctcaaaaatgtacagctacattagatattatgcactatattcttatctggcaaaactatttttaaaagaaataacaaacaaacaaaagcactcattagtggttatcttggggaggcagactgtggtgaagcaggaagaggaggtcatcaacgaggggcactaaaggggcttccaaaaatgaagcaagttttatttctcaagctgagccataggtaaatgggtgattattttattatcattatgtaatctttcatgtatgatatatttcatcataaataaatattgattttaaaggtagccggttttatctttaaatgatatatatatgcttctctaattttgtgtcctactttttattcctgtataatatactctgaaaactttccaatttcattaaaaattcctcagtaaagcatttttaatgtttggaacaaaatctattaaaatagaatagattcatgatatatattgttgggtactttcctaattttcattgctacagtatcagattcatttccattataaaaccagtgactgcttcagggcccacagaaatgggcacaattgtaaattcagtaggctcaaatatatatttttaaaaggctatgtttgtacatctttcttagcctgttggatgcgcagctcactgtgttgaggcagacatctgttggtatgcacaaaaataaaatattgttgtcttgtttttgtatttttcatatccagagaatcaagtcatagcttttgcctgagggagaacctcaagaaaaatgaactagtgtgacgtgtgtttctgccaagcagaaaagaacatggaagtaaacttatctacataaattaggtcagacagctggtccgagtctgcccactcagcctgctaggggagcaaccaagcaaaagttaagattgccaatttgtttcattttgtttccctctggatttcaggagttgatgtagaaaaaaaaatcaggaaggaggaactggagattaatcaacccagggatagtttttgtaacaggggaaagggatcgctgagataaatctagggagatgaaaactgggtttagaatatttgaggaggctttttgttttgtttcactatgcaaatggggaaagagtaaaaaaaaaaaaattaaaaacacacaaaatctcaaaaatgtgaatagtgaggaaaaataatcatccatatgggagtatccgtgacatttgtaaaaattccgtgaacacggccagacgcagcggctcacgcctgtaatcccagcagtttgggaagccaaggcaggcagatagcctgatgtcaggaggtcgagaccagcctggccaacatggcaaaaccccgtctctactaaagacacaaacaattagctgggcatggtggcgggcgcctgtaatcccagctacttgggaggctgaggcagggagaatcgcttgaacccgggaggtggaggttgcagtgagctgagatggcaccattgccctccagcctgggcaacaaagtgagactccatctcaaaaataaaaaaaaaaagtctatgaacactaaaaaaaaaaataagagtcccttgttagtctgtgtctaaaaaagaaactagcactggctcttgaaacaacatcaaggtatcaagctctgcttccttctgtctcataaagcacattgttctgaactaccttgagatatcaaaaatgtgtccaaaaacagttgaaaatctgaattattataactaaagggttatcaggctcaaaggaacctgagtttgagggtgggtcatctatttgcaacaaaatatttagaagtagttgagaatctgtcttttagagtaagtggatcgttgaaaatgcctcctctttttgccatcctcttcacttgggtaacgtccttagcctttttggatttaggctttcacttcatgtgccctgggaagtcattctagacctcattccattaggacctagacatccattactctaagtctgtcactgtgggctctctcttcccgaactaactgtgagctcctgaagaatacatactttgtacatcatagcatctcaccacccagcatagtgcctgatgcataataatatttgttgaatgaaaaatcactgaaatagaaagcatatgtataaaaatgttagttctagtgtactgggattcaaaggatcatcatgatctacacttatcagtcttaacttggaattaccagaaagataggctcagacatctgcaactaatattatttttaaagaataatcaaatattcagacaggccaggcaggaatacacacgctagacaggcttaattctggtgtggcgttcatcatcaaacatacctgagagtcatgacaaagtgagtttggttaagtagatatacgatttaaaagaaatacaacttaactgagagctcattactgagtattagtatgtgtaagaaacttgcatttaaaggtactctgtggcctctgtgtttatgccaattttggtagcaagcccattttattgtaggaagtcactatttcatggatccaccatttaactgggtcacattgggaaaattattttatgcaaatctttaaaatgaaaataatattatgctcatagggctgttaccaggattaaatgtaatggcaaatgcaaatcacctagcagtaccttcgatacattataaaccctccacgaatgacgcttccctctaacccttgagaacaatatgtcagtagcacctacaaacataaaataggatatctcttttaattgattgtaatttccattattatgttatttttgctatggaataggaaactctttatttttgaatttttacactgtttcatatattctagatgcaacatttttgaggagtatgatatgatatgcaaatattctttcccactctattatgacttttcactcttttaacagtgcctttcacagaggattttttttaacttccaaggaaatcaaattataatttttttatgtcattacttggtgttgtatctaacaatgccaaaccaaagtcacaaaaatttatcctatgttttcttttaagagttttctattgtaatttaaagctgttatctaatttgagtcattttttgtatataatgtaaggcataagttgaggttcaatgtctaaattgttccagcaccacttgatgaaaaggctagtctttctccactgaattatcttggcatttccatcaagaattgtttgatttctgaactttccaaatgacctcattgatctatgtgtctactcttttgcaaatatcactcttaattactatagttttatagtgcaagtctcaaaatcaggtacagtggatgctccaaatttgtttgcttgttttgtttttttttttttttttttggctattctggttcctttgcctttccatataaatgtatttttgtaattctttctttagaatcagcttatatatagctggaaaaaaattctgctaggattttgactggtattgtaacaagtttatagatcagcttaggaagaattgatatcatcatcatattgagtatattccaataatggaacatgatacatcactccattttttaaggtcttctttaatttctttgactagcgttttgtagtttctggcaacatataggtgcagcaattatttttttttagatttatacttacgtatatcaatttttgaagttttggtaactggtattcttttataattttggtttccaattgttcattgctagcacgtataaatataatagatctttggaattcacaatcatgtcatctgcacatagaaaaattttattttttctttgccaatatatatgccttttatctttcttttgccttattgcactgactagaacctttaatgtaatgttaaaaaggaccagtgaaataactagccttgtcatgttcctgttgttaggaagaaagcattcattcttttactgttaagaatgatgttagctgtgggctttttgttgataccttttatcaaattaggaaagtccctttctatttctaatgtatagagaatttttattatgaataaaattggaagttcgttgaatgcttttttctgcatctttgatataatcatttgatttttccttttttagtctgttaatatggtgggttgcaataattaatttttgaattttgaacggtccttgcatccttgagataaactatacttggttatacagttattactctatattgctgggttagatttcctaatattttgttgcaggtttttgcatctacgttcatgagagatactggtctgtagttttgttttcttctaatgtctttgtttagtttgatccctcgggtattactggcctactgaaataagtttagaagtgttccatctttttaattttttgaaattatatttaatgtaattccttacatgatgcaatgtttagtagaattaaccagggaaactgtccaggcctggagttttatctcttgaaagcatttaaactgccaatttaatttctgcaacagatagaggacattcaatatgtctctatcttcttcagtgacttttttttgacagctttaagatataatttacataccatgcgagtcaccctttaaagtgtacaattcagtgcgttttggtatattcacaaagttgtgtatctatcaccataatcaatttaagaataagtttatcaccccaaaaagaaactctgcgccctttagccatcactctcaaatgtccccagtccctctaggcaaccactaatctgctttctgtgcttatatatattttcctattggagtctgctatgaaataacattttatattaatggaatcataaaatatatagtgtttgactggcttctttcactcagtataatgtttccaagtattattatacttggaataatgtagtatgtatcatactttattatatagtatgtatcagtactattatactcactttagggctattaataatgatgctataagtacgcatgtgtaagtttttgtgtgggtgtatgtttttatctctcttaggtatacagataggaactgaattgctgtgtcagatagtaacacatacgtatattgtttaaaaacagtctgaccattttccagagaagctgtactattttgtattcccaccagcattgtgtccaatttctccacatcttccccaacactccttattgtctgttcaatgacatttaaaggtacgtgtccttcaagcacttggttcatttcatctagttcattaaatgtatgtgcatagacgtgtttgtagtattttattattatccttttagtgtccatggttctgtagtgataccctgtttcattcttgatattaataatttgtattttctatttctcttcagtcaacaggggaactgctgccaccactacctccaaagtggacttcattttcaaaggctaggagagttaaatgagtttcatcccatacccctaacccctgcttatctgtcctctggcctgagaaagtgttttgcttggaggttttttgtccatgcttggtgtgcacttcccagattcagcttgcagaagagtctaagccaggaaatatggggaaaaaaaggggagtccagggaacatattattgtatggggttatccttcaaactctgatttcctctccagtctgccattactttacagagtcctccaagatttgctttaagtattatgtccaatgttgtagttgacatcagtggaagagttagggaaaggtatacttactccatttttaacttgggttggtgccacaagctacccagtcccacgtatgacttactagtcacataaactgcctgacctagtgggaaaatctactcacctttctgctcatttttctttcaaggacacaatacttgaaggataatcctgaaacattacaagaacctaaagtatctttgcaatcaaaagaagattaaatcaagttcagtataattttagttgtctctaattacatcataatgtaatacaaatattttgacatcctttccaggaagaacatactttctttttaaatttaaataatgtttagattcctacttttgttcttacatcttctacctggtcttctctgacctacaaaacttataaaacttacagttgtattatgctctaatctattcctttttgcccctattcattttgttccttaacatattcctgccttgttttataaaagaatcccactatttaatatatcctcaaccacagttaaacaactgaaagatttgaatcatgctctccttctcagcacttagtttattggtatcctcacagcaagtaaatatcaaatcagttttgactgaagaaacaagtaaagtgagcataatccttcattatattctcaccctaaaatggcagaggggatagcattgcatccagacacttatatgatgagaagctggagacagttttacaggctcctcacaggtaaatgttgatagataggaggtcgtaaaaagggacagaacaggaaagtttgcacttactttcagggattgaagtctactgttttcttttttattatagaaggagatgggggtgagtggatgtggattggttcagaatatgaattatgacttgattagcctctcatttcataatggtggataagaaaaagctggtgatcctaaataaggcctgataattatctaggaatatcaggaattaatattctcctacaattatgttatagagataattaataagctaatttcttaaatgtttagttccagggtagtactccaaattttctacaatttgagtatcctgatttctggattaaatcattcccagacaatagcatcaattaggagatacatgcatacctctgttctgttttgcattaaaggttcacatctgtcatcccccccaaacattcattcttcttgagagaaagaattatgtcttatttattttgtctttattcattatttgataggtacagtgcttgtgcatcagtatagttcaatgaaggttaaagtgatcttctaattgtgatgtaattgcatgccattgtaccaatcatcttactatttttttttttttttgagatgggtctccctctgtcatccaggctgtagtgcagtggcttgatctctgctcactgcaacctctgcctcccaagttcaagctattctcctgcctaagcctcctgagtagctgggattacaggtgcatgccaccacacctggctaatttttttttgtttttagtagagacggggtttcagcatgttggtcgggctggtctcgaactcctgacctcatgatccacccgccttggcctcccaaagtgctgggattacaggcatgagccatcgcacctggccctcatcttactaaatttgttcagcatttgaaaacttttaaagcattatatctatatataaaaacactgaacttttttttttttaaactcagtcaatttctcatccctctatcatgtagctttacattattcaatatctgtacattgaaaataagggtttccacgtgtttgggaaagaggaaatctatgaataaaagttactctcatatctaatcatttgtatatcttcattgtaggaaaggcaatggcttaaagtgaagtcttccccatttttctgtgggaaatagatgttgctcattactgaacaaaaacccaggatgtatttgaatatgacatctgaattttagaaattttccaaagtcaatgtagagataatctaaaacagattatgctgaattttttggaccagtatgtgctttccaggtgggacagggaaacaactctgaggcttacctctaatgtattctttccttctttctttctttctttctttctttctttctttctttctttctttctttctttctttctttcttccttccttccttccttccttccttccttccttttctttctttctttcctccttcctttcttcctttctttctttctttctttcttccttccttccttccttccttccttttctttctttctttcttccttccttccttccttccttccttccttcctttctttctttctttctttctttctttctttctttctttcctttctctttctttttctttctttcttttttctttatttctttctctctctctctctctttcttcctttctgtctctctctctctctgtctctctctttctttctattatattttaagagatggagtctcactccatcaccccagctggagtacagtagtgcaatcatagttcattgcatccttgaactcctgggctcaagtgatcctcctacctcagcctcctgagtagctaggactgcaggcatgcaccttcatacccagctaaattttgaattttttgttttttttttagtagaagtgaggtctcactatgctgcccaggctggtctcgaacccctgggctcaagcaatctatctgtctcagccccctaaagtattgggattacaggcatgagccactgtgcccagccatcaaattcataatgttttaaaccaacaagaatcctcccctccccgcccctccccttcctccctccctccctcctttccttctttctttctttccttttcttttttcctttcctttccttccttcttcccttccacttccacttcccttccctttccttctttcttttcttttctttctctctttctttatctttctctttctttctttctatttttctttctctctctctctccttctttccctctctctgcatctttctctctttctttctttctttcttttttagagatagggtcttgttctgtctccctggctggagtggagtggcacaatcttggctcactgcaaccttcacctcctgggctcaagggatcttcctacctaaacctcccaagtagctgtgactataggggtgcaccaccacacttggttgattttctaattttctgtagagatgagatctcactatattgcccaggctggtctcaaactcctgggttcaagtaatcctccttcctcagccccccaaagtgctggaattacaggtatgagccaccatgcccaacctaaccattctttttgagattagggtagtcgcttccatcattaacctttatcatccacttaccttctgtttctttctttaatgaagtgttaaattgtaccccaccactgcattgagagaatacttttgagtgaaactttattagcctttgtaatatcagaaaagatctgtgtgacatatgcagctttaactaaaagaaaccactggttttgctcaaaacagtgatattttccagcaaatatcacagaggttcatacacaatttttttttttttttttttttttttgagacggagtcttgctctgtcaccaggctggagtgcagttgtgcgatctcagctcacagcaacctccgccttctgggttcaagtgattttcctgcctcagcctcccaagtagctgggactataggtgtgcaacaccatgcctggctaaattgttgtattttagtagagatggggtttcaccatgttggccaggatggtctcaatctcctgacctcatgatcctcccacctcggcctcccaaagtgctgggattaaaggcatgagccaccatgcccagcccacaaaattattaaaaggtaatttgataggccaggtgcagtggcgcatgcctgtaatcccagcactttgggaggccaaggcaggaggatcacttgagatcaggagtttgagactggcctggccaacatgctgaaaccctatctctactaaaaaatacaaaaaattagccgggtgtggtggtgtatgccagtagtcccagatactcgggaggttgaagtgggagaatcacttgaacctgggagacaaaggttgcagtgagctgagatcctgccattgcactccaccctgggcaacagagtgagactacttccccctgccgaccaaaaaaaaaaaggtaatttgataaattggaagctttaaagaatccctcagatagctttgctctgagagttctgtcaaatgtttattttttatacatgaagtagttttacagactaagatgctttcaaatttgcttttcacatttaattaaactgtcatctgtcattaagataactattaattagatgttcttgatatctttttaattctctaaaaaagtgactatttctgaaaaggaaaacatctttaaataaattccttcattataaacttagatcagatgacttagtctttcactatttttcttttggtataaaatacacggtttcttctaccattgtattccttaagcatgtgtaatagcgatacacttcaacaacagaatgaagctgctaaacattaggccaaaaaaatctcctttgctatatcgtgcgctgcttatcatttgaattgttaaaaatgtcttctcttcaaaataattttagtttgaagaaaggacacaaaactggtaaacctagatgctgtggactgaatgtttgtgtccctctcaaattcatgttgaaaccctaatccctaatgtgatggtatttggagatggggcctttgagaggtaattaggtcataaaggtggagccctcataatgggattagtgcccttataaggagagacattagataacttgcttcctttatctttcggctctccatcatgtagagacagcaagaaggcagctgtttgcaggccagaaagagggccctcaccagatgctgatgatgctggcaccctgatttgggactttcagcctccagagactgtgaaaaataaatctctattgcttaatccactactccatttaatttgttatagcagcccaaactgaccaagacaccagattacaataaaaaaaattaaaaacatattaggggaagtgaaaacagccctggatataaaattttgtcagaacaaaatacaaatctcagtattggttgttttctgtgatttatgttttatatattgcacattaacatatttccacttcattcagaaggtaaatcacatgaaatctaaccaagtattgctttactatattccaatccaataataacaacaataatgttaataacttgctatttatagaactaagactatgcagcaggcatttcaagagatctatatatgctatttaatggaaattatcacaaaacctctaagagataagttttattgcccttgttttacagatgacagaactaaggcttagactggttaagtaatttgcctaagatcacttattgttggtaagtattagagctaaaattataatacagcttttggttttaatatctacaaatattatttgcctactaaaccacaataaactaaattgcttagtctttatgtacttctctttcttttgacaaacctgacaaattgttcttgttatatatatataatatatatatatagcaaataattaatttcaaccattagaacaatagcaaaaacaacaataaaatcatttaaaatatggacaaaatgtccaggtgcactgactcatgactgaaatcccagaactttgggaggctgaggtgggaggatcacttgagcccaggagtttgagaccaacttcggcaacacagtgagatcccatctcaattttttaaaaaattattgaataaaaaaattacatcgacaaaacacctagttctccaggagtaaaaatgtataagattggcagaaaacttcttaagaaattaaaaacaacacttttttatattttggacattttttctttggttattttatattttggccattttttctttggttattaaaaagatgtagaattttgacaatttgaaaacagctaaatagcaaataaattaatgcattgtagacaaatgagtcttaaatttatttcttaaacgtttaagtaaaataatgtacagaggaacattgaagatctcctagttaaccctcttctagcacttacagatatggggcccatagagtttaacgtattttcacaattatatcacagtaaatctaaatctagaattttggttttccatatttcctctgtaatgatttctccacatgaccatggcacataaaatgatacttatggcaatggttacagtcctctatgtatgtctctaaaatgatgaaaccatgttgcatgaattagcaacggagaggatttcctcttccacagtattccgtactatcaataatcaactctattaaggatccctggtaagatgtgcattgtattattcatccatttaatatatacatttactgtatgtcaggtcctttgctaatgtttccagtattaaatgtcaggcgagaaaacagggaggggtataagatatatgtgcactaaaaatgtgtagtctctcggaaccaacccaaatgtccatcaatgatagattggattaagaaaatgtggcacatatacaccatggaatactatgcagccataaaaaaggatgagttcatgtcctttgcagagacatggatgaagctggaaaccatcattctcagcaaactatcataagatgagaaaaccaaacactgcatgttctcactcataagtgggagttgaacaatgagaacacatggacacagggaggggaacatcacacaccaggacctctcaggggctggggggactaggggagggataacattggtagaaatacctaatgtaagtgttgggttgatgagtgcagcaaaccaccagggcacgcgtatacctatgtaacaaaactgcaagttctgcacatgtaacccagaacttaaagtataataaataaaaaatgtatagtctatttggtgacatgggaccatatgaagcatatccagagtataagccatttagaagttgtagtaggcagcctgtaacattgtccagtgatatctgcctcctggtattcatgccctattcgcttctaacaaactgaatacagcaaaagcgatggtatgccactttagaagttatgttatacaaagatgctggcttgcatcttaggctctctctctctctctctctctctcatctggatcattcacactgaggtgccatgatgtgaaaaaatataggcagcatggagaggtgcccatttagtgaggaactgaagcctcctgccaacaaaaacatatgaataagcttggaagcagattctttagcctcagttgagacttagatgactgcagctctggccaacagtgtgaatacaacctcacaggagaccctgaccaacaccacctagcttagctgctcccaggttcatgaccgtcagacattatgagacagtaaatgtttgttgtcttaatttgctaaattttagggagatttgctatgcagcataaataactaatatggagaggataatgtctgttgcagttctcagtttttaaggaggcagagtaaggaagctgtaatttggtgggcagctcacactgttgcaggaaaggccataaaaggctgagtcagtactcatgagaaacgtttgcccattaactaatgagatataatatgcatgtcagttaggtgtaatgtgtaagttaaacgaaataaatctttagtcactaaggtttttgagcttggaaagttctctgagaaaaaaccatgattcagcaattctgactgcacaaattctatgctattgtctacatatgtgttcccccaaaattcatatgttaaaacctattcgccaatgcaatagtagtaagtggtaggacctttaaaagatgaaggtcatgatggttctgccttcatgaacagttattagtgcctttttaaaagaggcttgaggaagcttgtttgtcctttccaccacttagaacacatcatctatgagggatgcatcctccccagacattgaatctgctggtgccttgatcttgaatttctccagctccagaactgtgagcaataaatttctgttgtttataacttgcccagactaagatattttgttatagcagcctggatgaactgagatggtctaattataaaagcttactgagcaccttttaaaaagtaaataaaaacagagcagttagcaacaaaacctaatgcaaccacttgcttaactctgtatgattaaggtagatgtgtatgtgtgtatctttgtgtgtgtgtgttctagtatcttcagtgggtttttaaaataaaataaatgagttataactacaacagttacagacggtgttggataattgaaagggtttgcaaaattctatggaaactactcaaggaagacctattcaatgtaagaaatgcaacatagcagaagaaagaatgtgcagcccacacacccgggcctgggagacttgcacacctacctagagtcccttctcagtcacacaggatgtgcttcatctctgaattatgaatcttcaggatatacgtcccactgatcacatagccaagccatgctatgtaactggttagcccatgcgtaagccatcaatctacacacccctaaacattgtaaacaagctgactcttggtaccaacaaggtgatttcaaacttaaacaatgtattataaatataaactagttcaagccttcttattgtggccaaaagtcagtgtcagacctccaggtaatcatggagagttccagcccagctgtaagataactcttttccaaatgatcatttaaaacaaaagaaatcaatcattgacatgttatatatataatacatactatacatatatagttgcaacattacatataatacatatatttatatataatattgtaaatatatagaaacatatgcacatatgtacatatctttaatatatgtaatagatattcaaaaccagcataacagatgtttgccatgtgacactaaaatctggtttcttaacaatgacaaaagaaatgacaaatataggaaatgaacaaatacaaaaagttaagcataagctgatagcagtggaagccgaattttaaaattttggggtcatatagttagattcatgatattctaagcctcctgggtggggactggtagagtaatgcattttacagaggatagcgaattgctttctttatcatgtgactaatttagttattctggttttctgcatctttttaaggcttcttttataataataataataataataataataataattattattattattattattattattattattattattattattattttctgggagcccgctgactttgtattctaatgtggatccattgctttctggatctgctgggcatctgccaacttgccattttattcattacatctctgggttagaatcactatttcagcattccatgtcgtcctatttctgtttttcccatctcttgtttagtttgggcacactttcaagtcatttctcaagaagatctacacaagttacatttctgagttcttatgcacacaaaaaggtttttatttgaccacataatttggatgaatatagtattctaagatcatgttaattttctcatgaacatgaagccattgcttcattgccttgcagaactcagtgttgtgataagaagtctaacaacagtcaagcagaaactcacagctcctcagcagagccctcctgtgcacagtttagatagaggcttttgctgctctctttcatctatctccatgtttccagctgctttctatcttctggatcttttttttttccctgtgataatcctacacccatgcatttgccattaagagtttattcccttttgtgttcctttactgttattttaacgggatgttagactgggactgcgtagttatatcttttcagtttactcttgtgttagctttctaaatagatggaaaagacaaaacaaaacattgttagtaccttgactcaaagttatttgattgtaattgtggagatacggcaaatacattaataaatgcaaataatggaaaaacactaataccgatttaccaacagaagtagctattaaaggatatataaataaataacataggggagatggcaagagaagtacaatattttaacttacttcttcttccctcaaaaataatttcattttttatcaacatccatactttaattcctctttttacataagcattttgaggcatgtggtaagggaatttgtataacctttcttaaatcactacaacctacaatcaacactagactttagaatatctggaatcttaaagaaatactgccagcagtgtttataataaatgatacttttaaaaatccctatatcagcagaggaattttataatataaattgttcatttaactttaactgctacagattttggcagacagtaaaattaaatggtggatgatcaccagaatatattacattttgcaagatagcactgggttactaatacatttcaggagaagaaatctcttcccaggtccttaggctgctgtgtagtattattaagcagtaatactttcttttgtaattgatgaaagaggaagctgtaaattaccatgagctagaaattttgatttgtgaagtgaaaatatatttcagtagaaatcatggcttggcacacagtggaaaccgctttccagctgtctaaagtctccttggctttattcgaactacttctatcctccctgagctggttaactggacacctgatcgatgtccacttgttctgctctcagaattgttcttccaattgtggctatctttagaatatcctttccacctttagtcaagcaatctttcttcattgatgatcttatgatatctagtgtttacagtttttttgtttttctattatactttaagttttagggtacatgtgcgcaacgtgcaggttagttacacataattttttcccaagtgaaagagagctaaatagaatttacccatgcatgataaacaattaattgatttcattgaataaaatattcacatctattaataaagcttgtagataacattgtcatttgcaaatgttggccggctaatttgtttttttcttagcaacaatatgccctttcagcatttgcttttacgtccatgaagtctgatagcataaatgcaatataccttatttcggcaacagctataggtactgctcacctaagaaatgcttaattcttcatttactaaacttgctcgtcttgaaaacgtggcaatataattatacccattgtaaccacccccacccaaccaggactacatctgaggaatcacataaaaattggcatgaaagacatagttgggaagagggtggggatgaaatggctaaagctattgtcaattaagttctgctgcctgcaccaattacttaccaccaggggaaatgcaatctgatttacacactcgaattcacatggtttatgttctctcccaaactagaggaaagaaaatctaagggacataatatcttggtttattctccagcctcagtgaccttgaacctcgaattaagttttacagatgagtatataaaagttttatcagctcacatcaataaatatataaccagacttttctggctatatataaagacccctaaaaaagtaaaattagctgtctttgcagctacaggctattcatacatgaaatagatacttgcaacaactgaagggaattgtttcattagtttcataaatctgatttttgagatgaaatggaagagagaagccttctgccagtttgtctacatttttaaaaacatacactatgttatggtttataaaacattttacagtaattatctttcaaagatacttaactattggattactcagtagacagctatctagaacagagctcctaacagctctggtgaggcatattggtgtgtgttagtgagaggagctttcagatcttgagctccttagctctcaaggtagctgggaaggagctaaaactgcttgataactgcagagcctctgatcccctcgggccttgagcagccacttcttttctcccagtggctgtgcaaacattatgattttattttatttttttgagagacagggtctcactctgttccccaggatagagtgcagtggcacattcacagctcactgaagcctcaaactcctgggctcaagtgatcctcacacctcaacctcccaagtatttgggactacaggtgtgtaccaccatgcctggctaacattttttaattactattttcttcttttgtagagctgggtctcactatgttgcctaggctgatctcgaacacttgggttcaagcagtcctctcacctcagccttccaaagtgctgggattacaggtatgaaccactgcccagcctcaaacagtatgatcttagaaaacactagtctatgctgttacaaagaatgtctcatacttagtaatcttaaaaattagtgaagtcaaagtacccattccgttggatttaaaacaaaatataaagttcaattcagtatcactctacatttgaacaataccaggatacagatgtgttaaattttgtcattgtagttaaagaaagaagaaacctcagtatatcactgaagggtaaacgttccccctttttgaaaacctgcatagactcctttatacttttacatatacagcaaaacaaacattattttatgaagctagtgtcttggccatagaatcatattcacatcatatattctgctatggcatgtcttccctggaatgtacctcaatttggagtggtatcataataccttgtttaataaatctaccagaaataaagcaggcttttatgcttgttttaaaggtttcataaaccatctaaaagaattggctttgcaacaagctgctgaagggcaatgttcttggttgcataatatggatgcaagtagttccattgtcccagtgatgtccaattaagttggcagcatcaatcctcaatttcctttctctgggtccttttgcttcctcgttgataatcatcctctcctgcttctcatcatccccaacttccccctttgctaacagacttcaaagccctttattatgcagggaatatgccagtgtaagagtcttagtgtgaggcagagcactgtctgcaaagaagctcgaaggccaggtactcacccctatgcatgctgacagccaaggtgtgggcacatgatttaaactctactaagataatgcttctggcactggaagttgagtttaaagcaagtgaggcaaaagcagggatattttatgatttattccagtggtagaaccatctgaaatgtggtagcgaataaatgtaccagctgtgtggtccagtgtcataatgttatgatactgttagtggcattaagtgttcagagggggctggaatggtactttgaaaagctattctttgggatgactttaactgtgttcctatatgaagtgtcccttgcagtctgccagttttttcttcttgttctccagtcttcctgtgtttttctgcctaatttagccattcttaatttcagttctttgcaacccagaaccaaaactaatacttaatacttcatgtctaatctttttaaacataaattatttttctattgccttcagcacataaagatccatagagtaaatctgaattagtcattttacagaaatacgggaaagtaggatcagaatgaaagatgtgacctctttctctttctagatgatatcttgtttcccaggagaagatccatatgaggctagtcacaggtgttctagagttacagaagatacaagacctctggaacacctttgcactggtgaataaccacacagcatgttcccattctctggttcatcttccaattctcccttcttttcagcccatgccaattcatctccactgttgttaacccatccttcatttagcaaaaatctcaaagttactgtattagtctgttctcatactggtctcacactgatatgaagaaatacctgagactggctaatttataaagaaaacaggtttaatttattcatagttccacatggctgggcaggcctcaggaaacttacaatcatggcagaaggcacctcttcacagggagacaggagagagaatgagtgcccgaaagggaaatgccagatgcttataaaaccatcagattttgtgagaactcactgtcacaagaacagcataggggaaaccacccccatgattcaattacctcccactgggtccctccctcaacaaatgaggattatgagaattacagttcaaaatgagatttgggtggggacacagccaaaccacatcagttacatattttacatttttcagatatggcagtatctcaacccctctttatgattctttaatatccactcttaagccctttatattattcctcatttaacaataaaatttctatcactgtgtcagaatatattattttttaaaaaataaggctataccaacagtgtcactttagattactccatgtaccatgtcaaaaaggtgagaaaagattttgcatcacacaatacatattgaagattgcagtttttatagcattttcttttttctgacaagtttgtatgttcatttacttaaaatggcaagataagaatcttgccattcttattttagttctttaactggatccttagtctcttaactagatctgggtcctatataaatccagtcttccttggacagaaaatagatttttccactcagaagttctaacagctactttcttcaactcataatgtcacctaaggtcccacactcctatgggaacagaagcacttccacggtcatgagatcttactcttctttagagaggctgagttgtaatttaatttccaactttagaattatcaacacgaagacacacagttatccaggttagccaagtgatctgcagacagaaacctcttgttaatgctctctaattgtgttaaaaaaaaaaaagagttatattaacgtctaatccaaaaggcagaaaggatataatttgaaagcctgttcagactgcttaaaggggaggaaattcgccaacaatggctcccaaatgtgaaagcacagttactaccccttacagggatttgctggaagcattaccaaaattaggttcagtcagatctttcaacagacgtagttcaatgatggttcttgtaagtaattgaatacacaatattcatgatcaattgttcaaaagcttgctaaagaaccttttaaaaatctgaccccaagttttctggaagtggctaagatctaactctggacagtaatgaatcactttcttaatcttttctctgccccatcctttgacacagcccactgtttccaggggttgttttcctcctgaattgggatgacaacctattctcctgcttaactagactgtatcacagtgtaatcttgcagtacattttaaatttaaattttggagaaggacttggtgatcattgatcattgggcccctctgctatgtgtagatgctaccggggaaaataaaaataaagaaagtgtggtgtctgtctttaaggacattacaatctagtgggagaaacttgtatgtaaatggctgattatgatcaaaggcaaagtgaaataaacattaactagaggacaagctcatagtaatacagataatggagcaattaattctaactgaaagggaatcaaaagctcctttgcaaaggtggtggcatttgagaaagtgtttagaatgattatattttaagagggcagtagagaagaaaaggcaatcattccaactgcagggatagaattagcaaagccttagaagctcaattcaagagatttcgttttgggttttgatttttttttctttttaattctaacatacgacacaatggtaggccctgggagagattcaaagaaaaataatatgagtgtctttttctcctgtagctcatattccattttgaaagaaaagccttttttttttttttttttttttttttgagacggagtctcgctctgtcacccctgctggagtgcagtggcaggatctcagctcactgcaacctctgcctcctgggttcaagcaattctcctgcctcagcctcccaagtagctgggattacaggcacatgctacaacacccatctaatttttttgtattttttctagagacggggtttcaccatgttggccaggctggtcttgaactcctgacctcatgatcctcccgccttggcctccaaaagtgctgggattacaggtgtgagccaccacacccagaccagaaaagccatttttatgacagtatatctgaggagttcatcaagagcatatacttgtctgggatgatgtaattgagttggcacgtcccttaagagctacagtgcacgagaacagaaagaattcattattgccaaagatttctagaggacatgaatataagctttttcttgaaatatgcatagaatttgatgtgagaaacaaggggtagagatatttaaaaagagagtgatggcagttaataatcttggcatgtccccgccattgtggaagtattaacttaagtgttgtggaaggtgccttttggcccacatcagaaaaaaaaaaaaaaagttagaaataaaattttaggtgaaatcaaattcctccagagttcaagaaggtaaactgagtgaagaagactggggctataatgagacagagtggaagagactatggcatggtagagaccatggccaaggctcagtgaaaaagaggacaccactaagctccagccaattcccgtgaaaattatgttggtcaaaactccactggccacataaaaattctttgagtcatacctagtatgtagactactaattttcaaacactgccggactgcagagggtaaggactgctagaactaaaacctttagtttttataaatatttaagattgtaggacagagctgcaatgccaaaaaaaaaaagcatgttttaatcaagctacaaaatgcaagatatgtatatgtaaaccatattaaatgaaagggaattgagaggggttaccaactgctattaaagttttttcaaactacgttttaaatgaaatacatcttaaaactctatctgttgcttaaactggagtaaacaatttacaacaaaattttagaaaaatttattggctcaaaatttctttcaactgtctcatttgcctttgagacaaaaaacatgtaactatatggcaattgttcattctaagaaggtgggaattctggatacacactttccagtctcggcctcatcagatacttgatgaatgaacctgtatttgccatcactgccagttgccaacagtggatgccaccaggatatcttggtcagattcatttatgtacctgttctgttttggtccatgagcctggcaaacagtaaaactaggtgggggttggaggtttgcaacagctgctctggggcctgctgattcctgaattttatagcgttcataaatcacacaaaaatgtcttatgtccgtccacttccagtttaggtttttccccaacgtagtacaaaagaactgaagttgacactaagagtataatttgtaagccttcacaatacagtccagaaggtttattatttatttaaaaagctaatatattctatattctctattaagaattcctgacaggaggaggagcttagtaacagggataaatggggtggaataaagaatttcacatgaagattacaatattatgcttctatctgggtgaaatgtagcattccagatgttgactacatttcactagagtttgtgaacaatataaattcctgagatataataggtcagccctgcttcttaatgctgagaaaacacttagaagatcatcaaattttgaaaatgtactaatgagctacaaagtctgattaaaatcaaaggtgctatgttctaaaaaccttctttgtgatttagataagtatggcttatatttcatcatttatgacaatactttaaggcaaactttgcaaagacggaaaagtcttggtaataaacaacaattcactatagctcctcataaagtcattttcagaaagcagggttaaatcctgaagactgtataaaagaaaaggaaacacagagaaagacagtccacagatattactgttcacttgctaaaaagtaaactattaaggcctcataacacaaaacatgatatttccaattatttaatttggcaattatttataactaataagtccaagatgtgaagcagacgcaaacaacgatgaacatctcctgttagtaaattctggaggatagagtagtgggaagtatctttcatagacaatgtctccatgggaaagaaaattttcacatttttcagctttggttaagatcaaactgatctaattagttttctcatctaatttattgctcagaattccttttagtaaggcatgcttttcataaatttcaaagaaggctatttggagaatagtttggaattagacataaacaaaaatggaaagctttttcaaagatacaccaaaatttttctgagtaactaaaataacaaaattgggacatcataaactataccgttacgctaataataagatgctgtttatacataataacccaggattattttatattcattatatttgggatataggacataatttatctagagaattttaattaaaattatatacaactaattagaagaaaacagatttttttctcttctgaatgtgataatgtagccatatggattagctatctagaaaggttattataaatcaaagaggtattaataaacttgcaattaagtgtttaaataactttgtttcattattttctgatctcagagtgattgcaaacagtggcataaaactgtaaacctggtacctcaaacagaattatgatcataaagtatgctcacaagactaacacgattataaaactgagacagaggcaaaatattagtcctcctagattttacctaaccaattcctgataggaaatttttatttgtctaaaaaaaaaacccctgttacattcttcttttacttacattctattctcagaaggtagaaaaaaatcagggacacagaaaactctgtatgtggttttgaccaacatgaaaggagtgcttaaatttagttagggaagagatactgaatgaccagagcacaatcatctttttaaacaagtaaatatattgccataacttattgaaaaagtaactactatgtgccctattgataccggtgactttgaggagtggatatagcaatataaatttaataatatcaagagttttatctttccttaccacattgttagcattgcattattttagaaatatttcaaagagatagtaagaaaattacataccaagattcatcaatgattttgtttatcaacttgctagaaaaacagcaaaactgatcatcaattccctgcaaaccttgctaagcttgccttgcagcatagcacttcagacctagtctctagtgaatattattcaactgttggtttgtttctcttaattcatttcaaggagtggcttcaaatataaaagaaaaattaaaaaaatgactcatctttgtcccttctactcttttggctaaacaatgtgcatatcaaatttcatattccatatgcataacatgaaaaatgattctccaggatcgatgacttaaggttggaatttcaaatattttaggaatcacagatgcaccatcaccctagtgtgaggaggcaatagtaaaaattctaacctgaggatttcacaaattcacaaagggttttcccaggaaggagttctgctatcatgacttataaaaatagttgattgtcctcattgtttttgaatccatatgaattcagacacttctgtaagtttcttggagaaaggttaacaatagtgttaaaatgccatttcactgagggattcaagaactaagcatttgctggctggtttttcgaaaatactaacctgagtgctgcaatcaacacaaaagagtggttccacatttcttatgcaatcaaagaagattatgtgcaagaacaaattgctgttttgcaaacagactgcagatgaaggtaagagcatttctctggaaacgtaggacagacttgctgtgtttaagtaatgtaaacaaaaacttagggatatcaatgatacagttaacagagggtttggtgactatcacatacttgataccatatcagcctaattatatctcctaatagataaggcattaatgaacattctaagtggtttctgactaaggcctgtgggtaatttatataacgcatatatttatagaagacctctttttaccaatgaatatatttacttctcagtgataaatttcaaatcgcataaccaaagtgtgcaagcactgtatagcaatgtatgtcaaaagaagcaacacagactagaatctttcccacatgtatgaatattcgtagctatgtagattcaaataagagaaattgtgcagctgttattggcaactgacttaccagtacttgtaaggaagttaacatttctcattacaccttccgtgtaagcccctggctcgtaactgtccatttcacccgtgacgatgtgagcaactcttgctgcccggcctctgatagcacccgcagcacggtctaaattatcagcatcctggtctcttaaggctatgatacacttgttgacatcttccaagatatggctttctgtaagtaaatgaatcaaattagtttttgcgtgtgtctgtgtttaaaatcatacaaatctagcatattataattatgttaacttctgacttcagatagagtgcacattggaaatggaagactttgagaattataaaaaaattggagacatattttgcttacatccctttattctttaatagcaaaatccatgaaatataacatgttacatttttaagagaaatttgtattgactgcatattattttagattctagttccagtagattagattttagactgacatagaggtggaaattaaagacagtttctagattaaaatgaaaacaaaatatgtgatgatgaaattctacatcgtgaatgaaagcaatattatacagattataaaacttatatatacataagtcttttaaaagatggatttaaacaaatgaattccagagaaagttgcctactctgaagagtgtctcctgacctcatcctctccattctttagatgactaggccatgaagatagcaggaagttactatagcacagtaatattttctttcttcataaaatgattaatactcccagctaaaactaatgaatgaagatgcacaaatatgtggaatatcaacaaacatggtcaatgatatttctaacaaattgaaagaatattaaaagaattagtgttctggcttctggctttatcacatgaatccccacttaatatctttaacgactatttctttaaaacacacacagaaaacaattataacaataagatctcagtaattccagaacatatcattaattctctttctctctttttttgtccctctcactctctctgtctgtgtctctctgtctttctctttcccaatctgcttgtgtatatgtgctgactatgtgtgtgtttgctacaaaggacaattattcttcagttttctttcagagtcacacttccctcttgtcgtccaaaaaataaaatcagtctgggtgtggtggctcacatctataatcctagtactttgggagacctaggaaggaggatgacttggggccagaagttcaagaccagcctggaaaacacagcaagaccctttctttacaacaaaataaatttagccaggagtagcagcatgttgctgtagtcctagttacttgggaggctgaggtgggaggattgattgagcccaggagtttgaggctacagtgagctttgatcatgccactacactccagcctgggtaatagagtgaggccctatctatctatctatctatctatctatatatatatatatattaaattaattatatatagttaaaatttaaatgtatttataaacataacattatttaatcatatatgtattcatatatttcataatgatatgttccggaattactgagatcttactgttataattgttttctgtgtgtgttttaaagaaatagtcattaaagatattaagtggggattcatgtgataaagccagaagccaaaacactaaatatatcctaaatatatacgcacccaatacaggagcacccagattcataaagcaagtccttagagacctacaaagagacttagactcccacacaataataatgggagactttaacaccccactgtcaatattagacagatcaatgagacagaaggttaacaaggatatccaggacctgaactcagctctgcaacaagcagacctaagagacataatttttgaaaaaagaaaataaagtcaaactaccattgaatatggtccctgttaaccttctgagatctggcttctattattctgttatacatattttatgatttccaaaatccttcatgatcttccatgcctctgtcctgtgggcatattagaaccttggcctgaacagtctgtcccctttgacctgcttgctcaactcctactattctttcaagccactaggcaaatgttcctgcctcaggaaatgcatgctgacctcctcattctctacaacaaaaccaactttgttccatgttgtttaggattcacataaaatggtttatgtgcctcaattagagattctacctgtgttttaattatttacttttaaaaatatctctctagtagaatttgaaatatatctgagggaaagaattttatcttattcctcgaggtattctaagtagtacttgttataatacttggcacttgttaggctaacaagaatgcttgttgaatgaatgaatgaatgaatgaatgaagctctcttataagacattcttaaatcatgggctatgaacctaagtgaacacatatctgttatctgaaattagataaatttaacccatattaaggacatttaaagtcacttatattaaaaatattaaacactgaaaaccttcattataaattaactagggctttaacctaatttgcagcattcagttatgaatgtatcattaagccctacagtaaatacagtcatggtccaatctcaacagaaagcatatgtatattatcatatttcccctggaacagaagtataggttggaccttagaaggtatagtaatcatcaatttttaagaagtccacagatgtacactttaatgacacattaagaagctaccattttcacctaaccaagatggccaaataggagcagctccggtctgcagctcccagtgtgattgatgcagaagatggatgatttctgcatttccaactgaagtacctggttcatctcactgggactggttggacagtgggtgcagctcacaaggggtgagctgaagcaggacagggtgttgcctcacccgggaagcacaaggggtcagcggatttccctttcctagccaagggaagccatgacagactacctggaaaaacagggcactccctgcccaaatactgcgcttttcccaaggttttagcaaccagcagaaaaggtgattctctcccatgcctggctcagtgggtcccatgcccatggagccttgctcactgctagtgcagcagtctgagatcgatctgcgaggcggcagcctggctggggaaggggaatctgccattgctgaggcttcagtagataaatacagtggccaggaagctcgaactaggtggagcccaccgagctcaacaaggcctactgcctctagactccatctcttgggcagggcacagctgaacaaaaggcagaagacaactttggcaggcataaacgactctgtcagacagctatgaagagagcagtggttctcgttctcccagcatggtggttgagctctgagaatggacagactgcctccttaagtgggtccctgacctctgtgtagcctaactgggagacacctcccagtagaggccaacagacacctcatataggcggctgcccctctgggatgaagcttccagaggaaggatcaggcagcaatatttgctgttctgcagcctctgctggtgatacccaggcaaacagggtctgtagtagaactccagcaaactccaacagacctgcagctgagggacctgatagaaggaaaactaacaaacagaaaggagtagcatcaacatcaacatcaacaaaaagatcatctacaccaaaacgccatctgtaggtcaccaacatcaaagaccaaaggtagataaaaccacaaagatgggaagaaaccagagcagaaaagatggaaattctaaaaatcagagcacctcttctcctccaaaggatcgcaactcctcaccagcaatggaacaaagctggatggaaaatgactttgatgagttgacagaagtaggcttcagaagtgtggtaataacagacttctctgagctaaaggaggatgtttgaacccattgcaaggaagctaaaaaccttgaaaaaagattagatgaatggctaactagaataaacagtgtagagaagatcttcaatgacctgatggagctgaaaaccatggcacaagaacttcatgacacatgcacaagcttcaatagcagattcgatcaagtggaagaaagggtatcagtgattgaagatcaaattaatgaaataaagtgagaagacaaggttagacaaaaaagagtaagaagaaatgaacaaagcctccaagaaatatgggactatgtgaaaagaccaaatctatgtttgattggtgcacctgaaagtgatgggaagaatggaacccagttggaaaacactctgcaggatattattcaggagaacttccccaacctagcaaggcaggccaacattcaaattcaggaaatacagagaacaccacaaagatactccttgacaagagcaaccccaagacacatgattgtcagattcaccaaggttgaaattaagggaaaagtgttaacggcagccagagagaaaggttgagttacccacaaagggaagcccatcagactaacagcagatctcttggcagaaaccctacaagccagaagagagtaggggccaatattcaacattcttaaagaaaggaattttcaacccagaatttcatatccagccaaactaagcttcataagtgaaggagaaataaaaccctgtacagacaagcaaatgctgagagattttgtcaccatcaggcctgccttacaagagctcctgaaggaagcatgaaacatggaaagaaacaactggtaccagccactgcaaaaacatgccaaattgtaaagaccatcgatgctatgaagaaactgcatcaactaacaggcaaaatagccagcgaacatcataatgacaggatcaaattcacacataataatactaaccttaagtgcaaatgggctaaataccccaattaaaagacacagagtggcatgttggataaagagtcaaaacccgtaagtgtgctgtattcaggagacccacctcatgtgcaaagatgcatataggctcaaaataaagggagggaggaagatctaccaagcaaatggaaaacaaaaaaaagcaggggttgcaatcctagtctctgataaaacacactttaaaccaacaaagatcaaaagagataaagaaggccattacataatggtaaagggatcaattcaacaagaagagctaactatcatatatgcacccaacacaggagcacccagattcataaagcaagtccttagagacatacaaaaagacttagactctcatacaataataatgggagactttaacaccccactgtcaatattacacagatcaatgagacagaagtttaacaaggatatccaggacctgaactcagctctgcaacaggcagacctaatagacatctacagaactctccatcccaaatcaacagaatatacattattttcatcaccacatcgcatttattctaaaattgaccacataatgggaagtaaagtactccttagcaaatctaaacgaaaagaaatcacaacaaactgtctctcagaccacagtgccatcaaattagaactcaggattaagaaacttactccaaacaacacaactacatggaaaatgaacaacctgctcctgaatgactactgggtacataacgaaatgaaggaagaaaaaaagatgttatttgaaaccaatgagaacaaagacacaacataccagaatctctgggacacatttaaagcagtgtgtagagggaaatttttagcactaaatgcccacaagagaaagcaggaaagatctaaaattgacaccctaacatcacaattaaaagaactagagaagcaagagcaaacacattcaaaacctagcagaaggcaagaaataactaagatcagagcagacctgaaagagatagagacacaaaaacccttcaaaaaatcaatgaatccaggagctggttttttgaaaagatcaacaaaactgatagactgctagcaagactaataaagaagaaaagagagaagaatcaaatgaacgcaataaaaattgataaaggggatatcaccaccgatcccacagaaatacaaactaccatcagagaatactataaacacctctacgcaaataaactagaaaatctagaagaaatggataaattcctcgacacatataacctcccaagactaaaccaggaagaagttgaatctctgaatagatcaataacaggctctgaaattgaggcaaaaattaataggctactaaccaaaaaaagtccaggaccagaaggattcacagccaaattctaccagagatacaaagaggagctggtaccattccttctgaaactattccaatcaacagaaaaaaagggattcctccctaactcattttatgaggccagcatcatcctgataccaaagcctggcagagacacaacaaaaaaagagaattttagatcaatatccctgatgaagattgatgtgaaaatccttagtaaaaaactggcaaactgaatccagcagcacatcaaaaagctcatccaccatgatcaagtaggcttcatccctgggatgcaaggccggttcaacatatgcaaatcagtaaacataatccatcacataaacaaaatcaacaacaaaaaacacatgattatctcaatagatgcagaaaaggcctttgacaaaattcaacagtgcttcatgctaaaaactctcaataaactaggtattgatgggacatatctcacaataataagagctatttatgacaaacccacagcccccaatatcatactgaatgggcaaaaactggaagcattccctttggaaactggcacaagacaaggacgccctcactcaccactcctactcaacatagtgttggaagttctggccagggcaatcaggcaagagaaagaaataaagggtattcagttaggaaatgaggaactcaaattgtctgtgtttgcatatgagatgattgtacttttagaaaaccccatcatatcagcccaaaatatccttaagctgataagcaacttcagcaaagtctcaggatacaaaatcaatgtgcaaaaatcacaagcattcctatacaccattaacagacaaacaaagagccaaatcatgagtgaactcccattcacaattgcttcaaagagaataaaatacctaggaatccaacttacaagggaagtgaaggaccacttcaaggagagctacaaaccactgctcaatgaaataaaagaggacacaaataattggaagaacattccatgctcatggataggaagaatcaatatcgtgaaaatggccatactgcccaaggtaatttatagattcaatgccacccccatcaagctaccaatgactttcttcacagaattggagaaacactactttaaagttcatatggaaccaaaaaagagcccacattgccaagacaatcctaagcaaaaataacaaagctggaggcatcatgctacttgacttcaaactatactacaaggctacagtaaccaaaacagcatgatactggtaccaaaacagatatatagaccaatggaacagaacagaggctcagaaataatgccacatatctacaaccatctgatctttgacaaacctgacaaaaacaagaaatgaggaaaggattccttatttaataaatggtgctgggaaaactggctagccatatgtagaaagctaacactggatcccttccttacaccttgtacaaaaattaattcaagatggattaaagacttaaatgttagacctaaaaccataaaaaccctagaagaaaacctaggcaataccattcaggacacaggcataggcaaggacttcatgactaaaacaccaaacacaatggcaacaaaagtcaaaatagacaaatgggatctaattaaactgaagagcttctgcacagcaaaagaaactaccatcggcgtgaacaggcaacctacagaatgggagaaaatttttgcaatctacctatctgacaaagggctaatatccagaatctacaaagaactcaaaccaatttactagaaaaaaaaacaagtccatcaaaaagtgggcaaaggatatgaacagacacttctcaaaagaagacatctatgcagtcaacagacacatgaaaaaatgctcgtcattactggtcatcagagaactgcaaatcaaaatcacaatgagataccatctcatgccagttagaatggcagtcattaaaaagccaggaaacaacagatgctggacaggatgtggagaaacaggaacacttttacactgttggtgggtgtgtaaattggttcaaccattgtggaagatattgtggcgattcctcaaggatctagaactagaattaccatttgacccagcaatcccattactgggtatatatacaaaggattataaatcatgctacaataaagacacatgcacacgtatgtttattgctgcactattcacaatagcaaagacttggaaccaacctcaatgtccagcaatgatagactggattaagaaaatgtggcacatatacaccatggaatactatgcagccataaaacaggatgagttcatgtccttttcagggacatggatgaagctggaaaccatcattctgagcaaactatcacaaggacagaaaaccaaacaccgcatattctcactcattggtgggaactgaacaatgagatcacctggacacagggtggggaacatcacacactggggcctgtcaggggatggagggctgggggagggataacattaggagaaacacctaatgtaaattatgagttgatgggtgcagcaaaccaacatggcacatgtatacctatgtatcaaacctacatgttgtgcacatgtaccctagaaattaaagtatagtagtaaaagaaagaagaagctactattttcaagtatattggcaaggtttctttttttaaaaacaaatgcaacatatatgtattcaacgaatgtttactctgtattcactaaggtgttcaattttatattgtagagctattttcttagtcctataaaagtgaaagaatatttacagtaaaaacaatgtctgttcttggaagattaataatatataatacactatgtaatttctctttaattaaagatgaaatgatagcttgtacaaactattttttccccagtgaattttgcagaggagaaaatatacaaagaatattcactaacaatgaatgagtagtcacctcttctgtagaagtatgatctatatgcccatgaatttattatttaaagcagtgaataaaaatatagcaagaatttttctggttctttttttgtttggctttgcagaaggttgtgtgattactgctcacaattaaataatcctgtctgaggccatagtgttaaatcttgttgaagaattatagatgtaaggtcagatatggaaataaaagtcttatataaacatatgatatgaaaaaattataaataaaataacgaaaagaagctataaccagacttaacccaaagcagctatagtaagaatattagagaagatgtgtaaatgatctttgaaattactaagattaaatatagcacaaaataattagaaaaggttcacaaagtttgtattactgtgacacgttcccattaccctgaatgctttacagaatgctaggaacaactatttgcatgaagctctaaacatagaatgcccgaaaaagaaaatcaaaatgttaggtacctcccacatatgcacaataactaaacattaagcaacttcttaaaaatgattatttctctgctatttatatttctggtgaatttaagtggctaaaagaacttcatgaaggcttgagcttttatgcctagctacacagcctttaaacttttaggaaagaaaaaaaatgccaaataccttgtatacaacttcctactgttgaatctctttagactttgcttctgatggaatgggtttactctttaaacacagcaaaagtcatttggttctctcctcaaaaattttttttttctgaagtagatgcacttgaactcaacaaatgcatcatttttaaaatgaggttaaaagaaagagaatatgttattatagaacaagcacatttagaatattatgttttgaaggattgtcacatagtgaagatttttcttaacagcttcagagtatcagcttaacatttgctctgaggtgaggggtggaatgtcctggtgttagcgtaaatgctgaaatgcattcatttaagagcagacaattggtgaattattagcaatttctatcaatcatttttatagccatcttgagatgcaaagggtgatttctattttgttggaaaatagtaatacatgggataataaaggaattgatgttttactaaaagatactttgtttggtgcaagcttctctggctaactccatcttcagtcaccacaggaagtgtagcacaataaaattttgaaatgcatttttaaaattataattttttctagttgttcagtttcattcatatatatatatggagagagagagagagagagagagagagagagagagataaggtctccttctatcacccaggatggggtacagtgccataatcatagctcattgcaacctcaaactcttgggcccaagtgatcattccacctcaggctcccaagtagctagaactgcaggaactcaccgccatgcctggctgttttaattttttatagagacagggtcttgctacgttgctcaggctgatatcgacctcctcgcctcaagcgattctcctacctcagattcccaaagtgttgagattactggagtgagcccctgcacctggccagttttcaacagttaaagccagaatttaaaggtcaaatctattgccccagggaaagtagaaaacaaacaaaattcagtgaaaacaaaatgttaaatcactggctttctacagccaaagtagaattttataaatctatagtccagagaacagactgaaagtagcagcacattttgtttgcaaaagctagattggttcagaggtaaaagtttctccttttaattcctgaagtgggactttgaatacatcaacagcaaagccttaaggggaagagagtttatgctataatccatcaagcaagaaatgatacactatcaacagtttcctcccctgatatctacatacacaagaaaaagattcagagaagggaagaagagagaaaaagatattaactagtttttctggagaaactgagttataatgcaaaatcgattgaattttctaaattgtcaagattaattctagctacccagtgtatatgagctaagagacttaagctaaatttaattataaaaaaaagtttccatttttgcatacctggctccatagctataaattaaaaacacattacataggcaactacataaatgttcaacaaataaaaacaagaatacagtaatttttctttcccatttacccaacatacatgaaactaaaaagcaaatagaatgcattagtgtgtgagttaattgttgcttatctatgtacttacagaatttgtttgtcaggagtttgactatgatgattggtttccaaattaaataatatcccacagaaagatctaagcaaaaactagcttgagaatacagagtatgcatacagttaaatgtaaaatgtaaagtcccttcttcctctttacctcctaaatcctttcttctgtctcttctttccaaagtcttaatatatgttagaaaatgtagacgatataaaagataaagtacagtccctgtctgcaaaggattcacaatctagtaaccagaaaataaagcactttgtattttattgtcttttattccgcccaatacaatagtcaaaattgtagtcacttggtaattttacaaaagttttgttaaactttaacaaaatttgcccagtttctttgcactgaaagctgcttattctttcgcttttagacagctcgaatttagttgacttacttttgaaaattattgaaagaaaaataaagtccaatattgctatttacaagccaattatcaacaatacttatacaaactctgcagcacttattcacacacaattctatagaagaacacacacacacgaaaaaaaagaaagtcattgaaggcttcatatttctctcaatatgtcttaagtaggctcttgtaacaacttgtgtagttgttaagaaatttatcaaagcttggaaacagaaaaaatggactattgcttgtccttttaatgtcctgttgaacagacattgcaatcaggcccacctggcaaatatctaattctcaaggagtgtgtatctttgttccacttgctattagtgtcgatcaggatattttaaaactctgtaagagttaatgctctttaaaaaaaaatttgatgaccatgtaaatgattcttgttacaaaaagtgttatttttgtagaaaagataatcctaaaggctatagcttcattgctctgtaggacattaaccagttttgtttctaaatgagaaattttattgaaccattctttatctaaattttttaaacaaggcttatcattttagcgcctctcaaaaataaatttttgacacatgctcatgttaaatttgtaaaactcaggctttcaaatttataaaattatccatagactgtacaccttgacttggaagctactgatttttcaattagagtgctatccagaagaaaagatataaagcaaacattttatgttaaatcataaacctacatttaaaatgcagtactacaaagcttctgtaagataacagaggagaaactctaggtgatcttgggtttggcaagaacttttaaaatataacaccaaaaacataattaacaatttttttacaaaaaaatgaatacattggacttcgtaaaaatttaaaacttctactctgcaaaagacacttaaaagaataaaaagatgctgggcatgatggctcatgcctgtaatcccagcactttgggaggctgaggagggcagatcacaaggtcaggagtttgagaccatcctggccagtatggtcaaacccgtctctactttaaaaatacaaaaattagccaggagtggtggtccacacctgtagtcctaactactcgggaggttgtggcagaagaattgcttgaacctgggaggtggaggttgcagtgagcagagatcgctccactgcactccagcctgggtgacagagtgagaccccttctcaaaaaacaaaacaaaaaaaagaataaaaagccacagactggaagataacatttgcaaaacacctatctgatgcacgactggtatcaaggatgtacaaataattcttaaaattcaataataagaaaacagctcaattaaaaaatgagcaaaagatgcgagcagacacctcaccaaagacatacagatgacaaataaggacacaaaaacatggtcaacattgtttatcatcaaggaatttcaattcaaaacaacacatggcccatctattagaatgactaaaatttaaaacactgataacaccaaacactggtgaaaatgtagagcaataagaactctcgttcatcgctgaagagaatgtaaaatgacattttggaagacagtttggaatgccactttggaagaaatttcagcagttgcttacaaaagtaaacatacttctactatacaatcgagcaaccataccttggtatttacccagataaatttaaaacttacgttcacacaaaacctgcacatgtgtcttaatagcagttttatttgtaattgccaaaacttaggtgtaaccaacatgttcttcagtagatgaatggataaactggaacgctcagtcaatggaatgtacaaaaagcgatgaaaaatgatacatcaagccaagaaaagacatgcaggaaatttaaatgcatactgctaatgaaagaagtcaatctgaaaggctacatactgtatgattgcaattacatgtcattctggaaatggcaaagctacgggaacaataaaattcctagggagggtaaaatgtataggtagagcgtaggggatttttccagatggtaaaactattctgtgtaatactgcagtggtgaatacacattaatatacatttgtcaaaatccatagaatttacaacacaaggtgaagcctactgtaaacggtaggatttacataataataatgtatcagtattggttcatcaatagtaacaataaaggatgttcttcaaacattctacattcagtgtcaagtccattttagaccttaaataagcactgttcagcttctaaaataggaataaaaatattcaattacatacattatttacagatgtctaccaacaatgaagtaggaattgtgaacatactacaattttctgagaatataactaagaaaaagtttggtcctattctttccccaagtttctagccttcacacagtaacaccttctggttgtcaactggtttcttggagtttttaacaaatactgtttgagtctctcttcttttccaggcactgtgttgggtaacatatacataagattttgtttaattctcataataattccaagagatagatctgttacatttcatttttatagttggagcaaaatagagcctttgagctgataaatatgttctcaaaattcacaaagttatagtaatttgagtcataactcaaaatcaaggtttatctaacctgctaagtttctataaaaaatgctaaagtctcatctgacttcaagataaggtgattctataattatattattcagctattccaaatgtataatgggaagggaaaatcataggtttaaaatattttctaaattttatagaaatggtacaaaagattgtttatgctatagtaatctatagctgaatgcattataagttttcacattaattttcattgagcataagataatcatctatgcattttagaaggataattttaattctgcaaagcttacattgactatgctctggtaatgttaacattctggatctgtaataaggagccatcatagctagagggaacttcaagtattctagagacatcaccaggaaggtggccatagaagaataaataaacaaatgaagtttagtgccttagctacttagctattctggtgtaggagctaaagtctaagttattgcattttatgccattcttatcctgacaaaataaacaaacagaaaaagtgaaacaaaccttaggcattctcactcagaccatactcttttccatcaactcctctactactgagctttttcatgttaattgtcccattgcttcctctcccacagactgagaacctattaacatctaataacaaagcactgggttaaaaaaaaaaaaaaaaaaaaagaagaagaaatctttcaggatattaccagactgagcatcaggactgtcagcaggaacagacagtagtgagcaattctcccatattatgcaataaaaccattcaagtcttgcacactggatgctaatgttgaatgcctctgttgctcgattgtcttataaaaaaacagtcagtattcaatcgggtattattcctttctcatagttcaaaatacagaacaacttgagtgtccaaatataaaatctgtgcttttggacacagaaaagcaaatcccagtactgtttaaaataaccccctagaggtatatgacacatatagcagaaaagaaaccctaaacaaataaagtacaataaatgcaaatgcacagatagaatgcaaatgtacagataaaattaagaataaatgagttgctgataacctggtaaattttactaagtttttatttattttttcccctcagaataataagtatatacacagctcaattatctttactaccttcgaaaatacagtatctctccacgtgggaaaaaaaggctaacaaaagagaagaagactattagtagatatacgtcttagggaagttcactttcctagtcaatgaattaattttaaagtcaagtacagcattcttttgctgaaattcatttttctcttatattttgctcagaggtgcacaaaaattgtcagaacagatccctctctatgagacaaattctcttcagcatcatttgtaattgcttcaaggaaaccataactaaaaacttgaattttccacaggtatgacaaaggaggagtccatgaggttaaaagcaaacacaaggtatgactttttccatgcccaaatcggtatcattcacaaaatattctgtatcaccctgattgtttttatcatatgtaaattgctataaaactacatggaattggacaacaaattacaaagactaataaaaaaatacaaggcaaaaagatatggcttaaaaggtaccatgttttcaggaattcaatgtggttcatcttacctcagatttccaaaaagtctgtacttattatttacctttccatgaagtttctccatgaacctgccacaaagctttctagaagattctctaacagatcctaatcatagccattctgtaacctctgaacaagatcccaatttcaccagcatcagtaattgttctcttaagagttctctatttcttgatactctctgtaatttttatttatttatttatattgtttcagattcaggggtttcatgtgcaggtttgtgtaatggtgaggtttgggctcctagcatacccatcacccacgtagcaaaaatggtacccaataggtaatttttcaattcttgccccactcctacccttcccccttctggagtttgcgttgtgtgttatttccatcttcatgtctacatgtacccattgtttagttcccacttgtaagtgagaacttgtggtacttgattttctgtttctcagttatttcacttagattaatgccctccagcaacatttatattgctggaaaaatatatgatttcattctttttaatggctgcatagtattccatgcatataccatattttctctatccaatcaaataatagaatacaaagatatgtatttatatactattagctttctaatttaactctgaaagcatatgcaggagccaaaatcttattgaactgaataaactatacttatttagatattaaaagagggatactaaaattcccttttagttatattgaaccagttttatcctaatacatggaatgtaatcaggcaaaataattaatgatgtagtttactaaacttaattttaaaaagtattgaaataacttagtacaattttcaaggattaaaatgttaagagagtaattatattttcgcctcaattataaattgggcatccacatgaaagtgacaccttaggcttctgacatgtattaaaaccttgtaaatgaactcagtttacagcagatctagaaatgtttatgagtaatttaaccacagcttcccaacaattcattggaatagttattaagcattttaaagaaatgagtttatggatgggtagagttagatcaggaaataatagttcccaaattatcaccctcaagcaattccatttctagtaaatagtccccaaattaccatcctcaaagaaattccatttctaataaagaagatgcttttctatgcacacataagtttacagattcatgtcaaaataaaatttaaaccacagctactgattgaagtgaaacaatgattttaatttataatgcaaactaaccattggtaaacacaaataataactttatttaatagaatataacaaaccaatataagcttttcacttataaagtaattaaattacataaaaagatgcttatgacataattttaagtgaaaaaaatcaggctatgtatctattaaataggaccctcatttaaaattcatatatttatttctctacaatatagcatataattacatacattttaagaaaaatatatggaaggaaatttccaaactcctaattgtagttttcaataaatagtggcattatgagtagtttttattttttaaagcattgatatattttccataaaataatattgcatgcagtaatatacatgcattactattgtaagatactattaaaattatactctatccttgattagccattgttattaaacagagaactcttatagctaaggcttagggaactaagcaaactaccatttattaacatttatatattgctgaagtaaatataacattgatacccacagataaagcttaacatccttagttcttccagtattgttttcctctctctctttgcccaccaaatgatagtaattccaaactaatattttctatttaattagtactcatatatatattcacatggtatattcattcattcaatatctctttcattgaataatgatatattcattttaatgagtatttgcagagttcctactacaaggtattttgtgaggtgtagagaaatttcaagataaataactcactgtctttgctttaaaagaactcacagtctagtcgtagaaataagcaactaaagaaatgactccaaggaacatgataaatgccataatgtacatgggtaaacaatgctagaccatttatttttccaatgacatacttactttttccacatgtgtacatcattgcattatgtaccgtgagttgtcccactgggatcagactgatcacaatgtgtatatcttggtctttatgaaaataattttttaaaagtttattgtgtatttacaagttcctgggtgattgtgggagtaggggtggggcaattttcccatcaaaataataagtatatgtttaataggcattgctgacaacagctattaagagtttgaagacaagtaattgacttactgtgagagttattactagagtaatatttatataaaagatattttagtaagagagttttatgttacataaccaatttacaaatattattttatcacatggcttattgtttatattctctttcttttctttgcacattttaagtattttcagttggctctttcacaacttgcaaagtacaattcgtggcctttgtgtacaagatttcagttttgtttagatcagatttatgaaaagagtggcatgaaaattaaaaatcttccctgttaaagataggaacaccaatagttctcttatttcctaattatgtgctcaagaacaaattttttgtctcatacagaaacttggaaagtgaaaattggcatgaatagcagtcatatgcccagcagttacaacaattgcatgggatcagtgtaatgtatctatggtattgtatttagaagaaattcttgccaggactcaaacatgatgaaagacagtaacgcatagaacacacaaccatataataaggatcacagtaggagaaaccagtggacgtactgtaatgaggccagtgataataaaatcaggaagaaaggtaacatgacggcaaaaacactgatagaaatgagaggtacagtatggaaaagatagataaaacatgaaacagaacacttttttttagtgctaagactaaattaaaatcagagaaattataatcttctcttttactcaattcaagatcttgaatgaagatatgaaatttcttttaaaaatgcaaagagtgcagttagcctacatagcttattctccttttagttctaaacctccactgtcagaccatctaatcaaaccatcttgcacaaattcagtgttattatctcagcaaccttgcctggaaggccattccttgcatttaagcatctctgcatgaaaaacagattcacaacatctggtctgatttccttttactttagttttcattttgttgcctctttgattttatttccttttccaatcatgtctgttgaactgaaaatagtaatttcactgatatctatgttctttatttcacttcctatttttagggttagaggtctaccctgttgcttaaggttagatgtaaaataataatctgggtgactataattacccttgctttcttcatacaatttcaaatgttgacataagctttgttttcttatagtattattcacaccagacacctgagttaaaattgactgtgaatattttctcaatgctgtgtatccatgggctctgatttattttcctttcctgcatctggttgcctcttgtgtcttctgcactagtgaattttcaacattttaagaaagaaactgatcacttagaacaatattattttaacagaaaaaaaccacaagagatatataatattatagcctgaatgataaacataatacttgactttgacagtcaagagtaagtaaatgcgtgcatatggcaccctacattccatcctaatttattctgtggtatatgcgtgtgaagtgaagatgctatatattataaaatcacattaaaggaactaaataagaactggactatttttctcacacttactctgtcatcagctatcaaagccaaaatgcaaaattcctttgttccttatcctactatacagatctatgctgtcatctaaaaaacattgctgtataagacctaatatcattatattttcaatgaatagttatatgtagtgaatttaatcatgttccagtgatactgctttctctataactggcttatatgacatatgttcagctctttaagtgttaatttttataatttgctgtcaggtgccaagaaagaatatatcccctgatatggataatgtcacttctctgtcccaacaaacctaaatttatgccacttgtttataagttgtttatgtcaaaattatctccttgtcaaaacagcaaacttagaagatgaactcctaaatataataataatttacaatggcttaaaaaaattaagatcctaaaggcatacacatatgcatattcacacagacatatatgtgtgcatacatacatatgctttttatagcctattaaatttagtatttataagaataatcctgaagctaagaagctgataaaaaatgaaaacaaaacaaagaatcaaaacatgtttacaaagaaaatataaaaaatagaaaagaagaatacaaataaaccaaccataaggttcaagagaattaccattaatatcctacagatttgtcactatgctttctggcagccaaggcaaaagagaaacataatctgttggaacatgagataattagtaatttttatcatttgctttttatgtaacttaaatattctctttgtcaagctcttttgccccagtggatagctttgaagagcatatattataaatgggttattgactgaggggcctaatggcaaatgaaatcaatatacccacactaagcacttcaagctgtcgatattggcatgtgtgagaaagagtgatatatatagatatagatatatagatatatacacataatacacatattcataagtggcagctctatttccacctctctcccatgtcaattctataactgcatgtcataggtaatttggaaacaaaatctctggtagctttatccctctcttccctgctataatataaacttgtctcatcaagaaatgtttgagctgactcactttacttatttctttcaatagatagatagctatatctatcaattttattttattgctgattattcaacttttgatacctattttctcttccaacagcttcatataaaatcaaggaactctttgacttccctatgaatgaatatgccttactagtataattgggtgtgtcatatacaaagacaacacagacatagaaataagcctggtacctactgtctgataagtactgggagtattctgaattggaaaatggggactatgatcattctgaaaagaccacaggtatgtcataatatagagaagcaatcagataaagagaggcattaacatatagataaattatgtggccttattgttgtttgactaaattatgagtccttgagtgttgttttggctttgctgcttaccagttctataaacttagatatagtgttaaccataaacttgcatttcctcattaataaaatggggttaataagatttacagtctctgagacagttgtaagaattaaataaaaatatacatatagtccgggagcagtggcttattcctataatcccagcacgctgggaggctgaggcaggggattgtttgaggtcaggagtttaagaccggcctggccaacgtggaaaaaccttgtctctactaaaaataaaaaaattagccatggatggtggtgtgtccctgtaatcctagctactccagaggctgaggtgcaagaatcactgaagtggaggttgctgtgagccaagatcgtgccactgcacttcagcctggtgacagagctagactgtgtctcaaaacacacacacacacacacacacacacacacacacacacacacagcatagtagctggcatttagtaggcatgcaaatattgattgaattttgattttacttttgcaagttggttccatcattaaattattccatttctttcttttttttttttttttttgagatggagtcttgcactgttacacaggctggaatgcagtggtgtgatcttggcttactgcaacctccgtctcccaggttcaagtgattctcctgcctcagcctcccaagtagctgggattacaggtgcccaccaccacacccagctaatttttgtagttttagtagagacggggtttcgccatgttggccaggctggtctcaaactcctgacctcaggtgatccacctgcctcagtctcccaaaagtgttgggattacaggcatgagccaccatacccggcctcttttattttttagtggtaaatagaaatttagttgtaaatagatagctccaccgatagtgaggttaaaatgctcaaagtggaaaatgctcatgagacaaaataataactgatttcatctcacatgaatgtgaaatacctcagataaaattcatttgttcaatataatggttattatttcatgctgtattttatattactcataattcaaggaacataagaaagtaatcactaacccaacagatatacaatattaaagagactgtactgaattaaattagttgcattttttattatgagaaccattgattagatgcatagagtttattaatcctctggctgttcaaccctctttacctgtatatttccctgctgactgtgatttccttgaggaaaaacactttgtcttcttcatttattaaatgttcagtaccaaaaagagtgtcaggaatacaataagcgttcaataaaagttgttcaaatgaaccaatatcatacattggctttttcttacatttttatttcattaattactttgtaaattattttcagtttactcatatgtcaatatattaacagttaacagagacctgaaatattattgagatagagcagggataccactttttaaaagcctatggatctcaatcatggacataaagacaaatgctgagtttctaggatggaaattctaggaacctagttagtcctagaaataaataaggaaaataaggaacttgttaaacaagaagataatcgtagcctaaaacaacagccaaggaagttagagttccagagatgcttgctttctgcatagaaacttatggtaacatcttaatgtcactgagttgtctttcagaaacttggacccccacagggaaccccccacctaagggatccactggcatgaagacctcagataaggggaagtgaagactgaactttaatcatcatatttgttccaagttttttcccgagggccttggagaaagtcactccccctacctagttaacatttttctactcactccaattcttaaacaaacttctctgccttaaccaattgcaaatcagaaaatcgttgaatctacctatgacctgtaagcccctgcttcaagaaatcccacccttttaggcctaaaccaatgtgtaacctccatgtattatttatgattttgcctgtatcttctgctttcctgacatttacccttgcctttagacaaccttgtgtgcaagccatcaaggagatcaggatttgagcatttagctgcctggtcctccttgcttggcaccctgcaatgaaagcctttctttctatcactatcctggtgtagatatctggtatattagtccattcttacacctctataaagacatacctgtgaccaggtaattgataaagaagaattgtaattgactcacagtgccacatggctggggaggcctcaagaaacttaaaatcatggcggaaggtgaaggagaagcaagcacttcctacatggaggcaggagcaggggcaactgccaaacacttttaaaccatcagatctcatgagaactgactcactatcatgagagcagcatggagggaactgcccccatgatccaatcaccttccaccatgtccctccctcaacacacggggattacaattcaagacgtaatttggggggagacgagccaaaccatatcacctcgttttactgcacagggtgagcagaccccagtttggtcctaaaacggtatttgcaagacagctactgtacaatccgcttcattaataaactgcccttgcaaaatcatgacagtaagagaaatctgacatacttgactccatcttgcttctgacctctaagctgtgcttggtcattcctgggcatcagccaagctaactttgcgaggaatttatagtttaactttgaaacaaaaatgataatattccttccctaaaactaactcctccttgtttggagactgaaactgtctttgtaagactgagaggccacaagatagatgtaatttctaaaatcgcttactgatcaggagttatgtggtcaggagtcaagatttgtgaccttctcaattgctcctacagataacatcactactgtagaacctcagatttttttttccagatgtttttcagactaaccccaactggactcatgactcttgaatttactggtcttgtggcctcactcagaggcagactcagtacctgaggaccgttttctacacctttatgattttatcctcaaccaatcagtagcacccataacctaaatccttgaccaccaaattgtccattaaaaccccctaacttccaagccttcagagaggctgatttgaccaacagcccaggttctcttacatgggccagcttcaggtcaattaaactcgttcactactgcaatgctgtggtctcagtagtttgattttgtttgtgcagcagacagaaagaacctgttacatgattgactaaactcctagcgcatacttattgagattctattgtgtgctgggcacttggctaatttcaaggtaaagcgtaacagtactttttaatgtcctgactgtcttgagcttaaagtcctttaagagaaagagatattaaattaaataataagtataaaagtaacaacactttgcctaatgttattttagagaacaacttatgaatacattcacataagatgtttaaataagacactttaggtcagacttctccaacctgcagccctgtggcccaggacagctttgaatgtggtgtagttcaacacaaatttgtaaactttcttaaaacattatgaggtttttcctgtgggttttttttttcacatagtctatcattagtattagtgtattttatgtgtggcccaacacttcttcttccactgtggcccagggaagccaaaagattggacacccctgctttagatccatgaaaaatggttaggggcagaacattccaaagagaggggagatgtgggagaagtaagcgtgatatcctaaagccagggcgagtttggtggaattgtataatcatctcctgcctttgccctaaggccagggtgagtttggtaggaagaaatacagaagagttaagcaactatctaaaggatgctgtttcaatagtatgatcaatcagagtttaacattataatggacacagaatgagtgtctttatacagattccagtgaatttatttggactctaaaaatgtttagagtcaaataaccatgattgcactccttgctacacagctctggcttagatctaatcaaagtttttgatagactgcttgacacagaaaactatggttgtggtgttaaattatgtgatttatattaaataagtgacctgatgtctagaacataatgtgttctcaataaatttatttattaacaataaattgcgttaatattccaactaataaattatttaagaaaaatatgtcgaatagagtgctaaatgattgtagtcaactaactttaaacagtgcatctaatttcagtgtttcctttttaagattggctcaaaatgaggtacactgacccccatcattgccatttgcattcatttatatccagtgttcttctcttatatatgagtaatataagaatcctatatatctttctaacttgaaaccacaaaaacatctcctgaacttttcctctggtggtttgctttgggtagcactaccaactcaatttcctattcttttgctgcatatcatatttgagccatacatcataatgtacttgactcagatgtctggtgttcctgtcctatgctgcactagcttgcaaggtcttgctttttcttgacaacctgcctcttaaaacagatttcaaactaaacctcctggttttgtaatttgatccaagtctactcccttggacagaatatcagtaacaggatttgccacatcttttcctttcagccatactgactaccagggtggaaatagtcatattttgaaagcagcatcctttcagactgctttgtccgcttatatatacattttaactctttagtttcactccacagtggaaagagagaggcaaaaatgggtttctctgaaattgctatcagcagtgttatctctcttcaagaagaataaaaaaaggatcttattaaatggcagttaatgacaatgaaaaaagggatctgagaactaatgaaaataattttgaggaatattctctaactatatgcattatcttggctcccaaagaagacccacctccacttttgaggaccatcatttagaatgggcatgaaacataactcagtggtttgatgaagaagtgatgattgagattctttcatctcttcatttttaggcactgtttttcatcaccaccacaaagaataagaatggaatacaaaatactgtgggggtttttatgttcattgaaaagctttttcctgtccaaggtacttgttctataagctttcttgctgcctggatttccagtgttccaaggaaattttcaaaatgtatatgaatttgttttccataccaatgcctgagtcttaaaccaaaaactatatgaagaaaagtctttattgttataataataagctgatgttgaatacttgtacatccaaggaattcttcatatattattagttccattaatcttccaaatgacacaaagagataattagtatcattaccttcattcttatcaaagatatagagacaaacactaatcaagcaacctgctcctagttcaaataccaatatattaagtggtatagagttaggattacatctggacaattcaactcaagagctcttgctctaaaccacttctccatgctgccactcttgtataattatgtcattataagaatatagatagtataatgatatagataatttttccatgactatttagtgaaataaccatacttatatcttcctcatagcaaaagcagatcatttcgatatgttttgatttcttaagttttaaaaggtttctgaataaaattttctttcaaaggattttatttacatagaactaattaatttacccttttattaaacactatgaattttctcttcaaagggctcctctgatactaataaatgcctatcctccgactttccaagaatatcaaacaccagccaacagatttatgtgatagtggaaaacacccaattagcttcggtagaatgctttcttaaaagtgcatgtattctaaccttgtagggaatttaaacaactgtgcttaaaagaaaaaaaaaaaaacaggaaaggaagatttgagtcaattcatcatttttattatgtactctcaactcgacccaaaacacatctaaaaaaacctatattttagtgacatttactactactttgccactccacttttaaagcagcctatgtgaatatcaagtggatgggcctgtttctgtacaatatcacatactataggagaaatatctagcaccgatgataataataataataatttaaaaactctgaacactgctgtttgttagattactccagatatttgaatattccttttctttcttagttctttaattagctgtggctttgatatgagacatatatttatttgaagctaaaagcccactttcacaacttttacatattttttttttttgagacagagtctcgctctgtcacccgggctggagtgcagtggcatgatcttggctcactatcacctctgactcttgggttcaagcgattctcctgcctcagccttctgagtagctgggattaaaggtgcccaccaccatgcttggctaatttttgtatttttaatagagacggggtttcaccatcttggccaggctggtctcgatctcctgaccttgcgatccacccgccctggcctcccaaagtgctgggattacaggcgtgagaaaccacacccggccaacttttacatatttttaaatgttttcattcattatttgcagttctgttctaacgcataaattatagtccttcctggtatcaatgcagagtttgttctacaaccccaacggatatcaaaatccacagatgctgaagttcctggtgtaaaatggcatagtatttgcaaataacctacgtgcatcctcacatacacttgaagtcatctctaaattacttataatacctaataaaatgcctacacatagcttcatctgcacagattcgacatagtactcaatgtacagtcaaattcaagttttgctttttgaaaatttgtaaaatttttattttcaaatattttttatccttagttggttgaatgcacaaatatggaacccatggatgtggaaatccagttgtaccttttaaatctccattttttatacaattcttattttccaaatggtggccttttttctctccttcaactataaaattatagttcattaaaccatttatttattttcatagagtatatgtcatattttagtcacaaaacctcgaccacatgacagaaggggcacctaatcattctcattggcacacaaggtcttgttaaaattataaagtagacaaatattctcttcagtatccttctatctttatatcatcttttaatgttccttcttccaaacccaaaattttaatcatccttaagctgtacaaagtatcctacctaggtcagccataaaggtcttcctgatatataaatattcctccaactttccatttattctttcaataatactcttactctttagtgaatatagccttggcaatcaatgtttggattaaagaaattcacactaaaatgtcaatgactgtaattcagatgtctaatgagtacattaaacattttaaaagaacagtgtataaaacctagctgaaatgaatatataatttatacactggaatggagagatatttttcaattggagagttcttcatactaatctttttctatatgagcaggccacaaccacacatatctcattttcttgacagaatcctgatggcttaagttgaactagaatatttgaaataacttcaaagagcattggcatacttttttgctaataggtacagtataccaaaacaaaattattaaatttctggagttatcctatcagccaaattatttttctatcaagtccacttctattgacattttctgggtattctacatatctctcatattccaaatagtgaatctgcctctagaaatatggctaataaagatggcttcaaatcaaatagttaacctgcctctagaaatatggttaatgagggtgggttcaatgggaaattcctgggaaagtctgagcaatgagaagtggtcaaagagaaattttgggatttgagaatttagattgctctaactttgcttcatgtttttggtctacttaacatgccttctgaattttcacttcacctcatctcatcctcttcaatctaattctacagagaattttctaactgttcccaaaaaaaaaaaatgtctttttaagaaggatagagatgaacttgggaatcttcttggttcaatagttactgtggggaaaccaggagagataatataatcataataaaataaatatagccaaacatagtggtgcagtatgatgaatatgacatctattatcaagtctgattttgtggaattttaaattggaaatgctttgggaaatccagaactcaacggatatactctgatggcagtgagaccataactatacaataggtcacattgtcttctagctgaaattactaaagagacatttagtttatgtattaaacacaaaacaagacaggatcgataatatttttatagttttaatagttaggtcaacatctagaacttaaaatgcaacatttaaaaccaagaacctgattatatagaattagaaaggtacaatcagggaccttcacttattccttatttttctcctaaggaagtcttttagagtgttctgatactgccagttctgctctgggaaatctccatactcaggaagcaccaagtgccctagacctttcccaattctctctccctaccagttgcgttttctactccttcagtggcctggcttgctccactgttattctgattaagtaatctgtgctaaaagcaagcaataaacatccagacaaatacatctatatttttaaaaggactttctaacatgaatgctctaattacaaaatgttgcagtaaatctattcaggaaagctttataagtaactaaatacatttaaggatggctgttaaataatcagatcaaaaagataaaaaagatcagccttgaccttggaacaaaactttggtagaataattatctttcaggtggagtcaagattgcagaccagcctgctcttcacagagtattctaatcttcagatagaaacactcactctcttccctctagtagttccatcatactttagtacctactcaggcctacttctagaaaaaccaaaggggcatttatttggtgaactttgcaacccagtaccaaataaagagtatgctagtcccaccctgatgttaggccctggtactagcaaacctaagcttctgtgccttggccccacgcttttatcatgcacaactgtttctgtggaatagagtctacctctgatcctcagtccttgagatgaggcaattctaaatactgattgccccccactcctgacctttccctctgcctttctgcatattaggtgtatattggttctctgtcactgggtttcccctgccttctagaataatcataaataatctttgtcaggaccctatcacagatcatcttcccatcttttgcctacttctcccattaccagacacaaggctccatctgccagagatgtactgttcgtgtttggaatgcgtgctgtgtttctaaggctctttctcatcctggtgttggtcataaagtgcctgtgtctcttaaaacttacaccattagcaagcatttaaaccagcggaactcttaaaggcaattgagccctctcaatatatagaagagtatagagatctaaagagtgaagtgaattacccaagatggcataatatgtaactggcaaagctgtgattagattaatttgaatttcaacattcaacacatatttagcttctctcaacttcaatttcttctgtcaatttgaaaataataatgtcctatttgctaacagtgtttgaaaattaagaaagacatgttaatatgcctaaaattatttttctggcataaagtaggccttgagtaaataatgtgtcctgtgttcacattttttcctcacatctttggtaaaatcattgattcttaaagtatagaccagaatattaagaaaaataatataaagcaagttatgtttaggactaagttatctaaatgcttactgtaatggagctattcagtatactcctttaatttattttgattttgtgtttttctttgattttgtttttccttctggtacataaacactatcaggagataacatttttatcattactatattatataaatatttttagaaactattgtcaatatagtaattatgaatatgataattaccatgaggtaattttttatataaatatggaattcaaaaataaatttaacaaatatttataaggtttaccattggataaagataatgtgggtgcttgagacacagtgctgaacatgaaagacaaagttcctaagcaagagagtctacattttattaaaaataaatgatgacaaaccagcaagtagataaggactataatttcagacagtgataaatactgtaaataaaataaaatgaggaaaataactaacaacaaacatggtggagttcaattttacatgagtgtcttttagattggttctgagacacagcttcttgtatgaagaactatatgcagagttcctccaggaaacacacccaaaaggaaatgaggaaggaattgtgcaaaaagagaaggtgacccactgagccctcaaatgacattccgaggagctctgaagcctgtaaggattctaccaaattggggcaaggagatgacctatccccatctccgtcagtcgctgatgaaagccatcacttgaaagggtataactttgggcctagaagtttcctacggcaaaattgtggatccaagtacaagagtaattatcacaatagaacatgaaatctaagctgagtaagacaggaaacaaaaacgtgaggaatgaaaaacatgcattcgatattccagcaagataaaaagctaatttggcatgaaggattagagaatacataatcagaaagataataaagtggtggtcagaaaatagcatcttaaaagagagattctggaaaagaaaaatatacttggaataataagcacaggaatggctgactacaataatgttgaagaaaaagatcattaaaaatgaagaggccacaaggttgagaggccaaggtattaaataggttggtggaacaaatgtgagctgcacagaaagatagcttaaaaagtagtagaagggaaatcagagagccaaatactattttttttttttttttttttttgagacagagtctcactctgtggcccaggctggagtgcagtggcatgatctcggctcactgcaagttctgtctccctggtttacaccattctccttctcagcctcccaagtagctgggactacaggcgtccaccaccatgcccagctaattttttgcatttgtagtagagacggggttttatcgtattagccaggatggtctcgatctcccgaccttgtgatctgcccgcttcggcctcccaaagtgctgggattacaggcattagtcaccgcgcctggccccaaatattaatttttatttaatgtgagccagtatcttttttattgttcctggaatattatttggtaaaacttgaaaaaaaaatgaattcaattaccaaatagtttaggaaacacttaggtgaaagtcacataggtgtaataactctaggatttcttgaagtgattaacactttatattaattttaagtatccaaaagaaagataacatacatcaagttttataaaattttcagtgattatatcacaggaattgcaatataagtaacatgttgaggaaatgctaataattcagagtagcaggtcacaagtctttgaaacaggatacaacttatgagtactctatcttgtaaatgcacagacacacacacattgtatacagttttatgtagttagcacaagtcttggtggtaatccatagagcctacattacaaacctctactctccattcttgctggtaatatctggtccatgggtcagcactattggcaccccttgagaacttgttgtatatccagaatctcaggtaccactccggatttactggataagaacctacatttttaaaagattctcagatgatgtgtatcacattcaagtttaaaaagccctgcactagaaggttacatagttaattttcacactcacaaagaaaaactgttttacattgttagagaattactatattttcaaacagtgttctgaaatgtctctgaatatttataatgactcaaattggccttaaaaacaggtgggaattagctctcttaatattttgtcacttttataaaacaaaatatggtaacatggtattaactattaattttatagttggtacaagcaatagagcttgaaaaggtattttcttgtgtcttaataccactaatgtatgatttataaaggcatggaaatacaatctcaggagtcttaatatttccttagaagattaaacagccatgtaaatccattatccagaaggttagacataaatgtcagttcctgagtgtcccacaaaggaaagtgtggattcttaataacagagaggacacaaggtctttccttgagagatttatgtctgatcacaatttcccacgtttaaatatccacaatcaacaataggtacaactttgtttgccaaaaaagacttttaaaatatcaaatggggagatacagaaaagaatataggacaatattttctgtgcattaaatcttcacagataaattctactacttgatataatcagtccagtccttccttccttacagatatatcttttaagagaagaattagtaattattttattctcctaaatttattcttcttttttgtttgtttattggtgaaacaaaaggattattaaaacacttaaatatattagtatgtttaaaacaaatgctctggttaggtaggttagttaggtagttcaaaaatgggttttgaaatgggcaccttgggaggcttcaggatggctgactagggagcattttgtacttgctttctccactaaaaagagctaaaatacccagtagatattagatcatccaagagagaacactggaatccaacaaaatagtgacaggcaatatctaaagtaaggaatgggagaaggaagcaagcagcctgttcagcctggattgactgagagcctagagagactccccaatagagggaaacggtaggtgagagatgctcagcagcctgcattttcatcatagactcctatagtcctagccacgggagagtcctcaatactctcaggccatgaaactaacatagggagttgcaagaagattgtattatggcagcttcccatggaggaagcttgaatatggtcatggtccttcacattccttgtgacctaagcaactacagcaagatgccattttagaactttgcctgcaacagactgcacactgtcctggaacccaggaatgctgaggctaatgtgcaagagaagcattaggctgctgctcccagggcttaggcacaagtgaccttgggccactacactctgatggagttgcaaccagggtatgggatgccatctttaggactgaggtgccagcaaggtgccattctagagcaccatccccagcaaactgcacactacctgaagcccagtggtgctgaagctgaggtgcaagagaagtgatgggtactgcctggggtttagacacaagtgaccacaggcttctccacccaaggctgagcaagggtgccaccaaggctgtggtgcaggtggcatgcatgctccccacctgctgtcctaggccatcatcactgaagctggtaccaccctcaacccccactggcagggcagcagggcagctactatagcctcccactcaagcattccacaatgacttggggatcaccccgctcctgactaccatggccagtgcctgtacatgccatctgggggcctgaagataagccagcctagcccaggtttccccatcatccccatgccacagcatacagtccaggggccagggaatctcccagtttagttcaccactgatgacatatgaccactcctctcggggacctgaggttaggcctacccacacagcagctactaccacaaattaccacctgcaggcctggacactgaccttcccagaacattacagttacttccaatgacagcatgcaccacaagggacctagagggttgtcacaccactgccactcgcattgcctacgccatattagctgcccatggacccaagaacccacttacctgctcagttcacagctgccactactgggctttgagtaagccacctgaaggaacaaaaattggcccacctgtatgacattatggggcatatgagcaggcactctcagcccactgctgcaaccacaggagctcaaagactggtccacttgacctctgagtcccaagcaaaactgcaccagagctttcctcaataactggaccctaagccaccaaggaagtctcagatatcactggcactgtttgtagccaaaaaaatcaagggagactacactaattcatgtacctagaattgaaaccagagttccccacccaaccaacaccacagattcttcctcaaaaaaagtccttccctgtgaaagcaaattgaaaaagttagaagaagcaactgctacatgagatgcacggatatcaatgtaaggacacaggaatcatgaaaaagcaagaatatatgacagctccaaaggagatggaattcataaaatcctagtaaaaattcaattattgattctaaataatttcagtgagatataagagaattctaaaaaaacaaaacaaaggaatcagaaaaacaattcaggataagaatgagaaatgtaacaaagtgatagataacgtagaaaagtatcaaacagaaatcctataaatggagaatcattgaatgaattacaaaatacatttaaaagcttcaaccatagactagatgaagcagacaaaataatttcacaacttgatgacagtgttttataaataaccctcagacacattttttaaaaaaaaagaatgaacaaagccttaatgatatatgggacagaaaaaaaagtgataaaatatataaattattggtatccaagaaggcaaagagagaaagagtttaaaaacctatttaatgaattaatagaggaaaatttcccaaatctagcaagagatttaaacatccagatacagagtcccagcagtcaccaaacagacacaatacaaaaagttcttcttcatggtatactatagttaaaatttctaaaatccatgaaaaatagagaatttttttttttaaaaaaaagcaagagaaaagcatctagtcacctataagaaacctccatcagaacaagagaaaatttatcagtagaaaccttataggccaggagagaatgggataatgtattcaaaatgctgaaagaaaaactgcaagctaagatactatatctaacaaaattatccttcataaatgaaggagaaataaagtctttctcagacaagataaaactaagataattcatcaccactagactgaccatacaataaatactcaaagaactcctaaacatggaagcaaaaggacatttatctacatgaaaacacacaaaagtataaaaaatggtgaagcaaacatacaaatgtggaaaaagatagggctcaaatactatccctacagataactaccaactgcaatgacagacattaagaggaaaatcaagaacaaagaatatacaaaccaaccataaaacaattaacaaaatgacagcaataaaacctcacatatcaataattactttgaacataaatggattaaattcttcacttaaaagctatagactgaatgaatggattttaaaaaaatgatccaactacatgccacctacaagaaacacactttacttgaaaagattcctatagactgagagtaaataaatagaaaaagatatttaactctaacagaattcaaagtgagcagaggtagctatactcatatcatacaaaacagacttgaagccaaaaacagtaaacaaagacaactaaatagtgataaaaggaccaatctagcaagaggaaataacaattctaaatatatatgcacccaaaactggaacacccggattcataaaggaaagattactaaatctgaaaagaaagactccaatgcaataactgtgggggaatttaccaccttattctcagcactagacagatcgtctagaaagaaaatcaaaaaagaaacattgaagttagagtggaatttagaacaaacagacctaacagatatttatagaacattttatccaacaactgcagaatacacattattttcataatcatacagaatattctctagaacagaccatctattgagccacaaaagaagtctcaacaaattttaaacaagcaaaatggtatcaagtaccttctcagatcacagtggaataaaacaagaaatcaataccaaaaagaaacttggaaactatataaatatacaaaaattaaataacatgcccctgaacaaccattgtgtcaatgaagaaatttaaaaattttgaaactaatgaaaatgaaaacaaaatatatcaaaatctgtgggatacagctaaagtagtactacgagggaagtttatagaaataattgcctacatcaaaagtagaaatattacaagtaaataatctaacaatccacctcaacaaagtgaaaaatcaagaatgaaccaaaccaaacattagcaggaggcaagaaataataaagatcagagcagaactaaatgaatcagaaactagaaaaacaataaaaagcatgaatgaaatgtaacactagttttttgaaagtataaacaaaattgaaaacattaaaaaaaaaaaaaactacgagctagactaacaaagaaaagagaagacccaaataaactcagaaataaaaaggagacattacaactgatacaacagaaatacaaaagatcatcagagactatcacggaaaactgtatactaacaaactagagaatctagaggaagtagatacattgctagaaacatacatacaacttaccaagattgaatcaggaagaaatagtaaacctgaacacaccaagtagtgaaattaaatcagtaataaaaagtctcccaacaaagaaaagcccaggtctggactgatttactgctgacttctaccaggcctataaacaagaactaataccaatctttcccaaactactccaaaaaattgtaggggactgatttcttcctaacatattctataaagccggtatcattctgataccaaaagcacacagggacacacacacacacacacacacacacagaggtataggtcaatatctctgataaacataaacacaaaaaaccccaacaaagttcaagcaaactgaatttaacagcacatcaaaaaaataatacccaatgatcaagtgggatttacccaagggacacaaggatgttcaagatatgcaaatcaataaacatgaaacatctacagaataaggaataaaactcatatgctcatcttatagacaaagaaaaatcttttgataaaattcaacataccttcatgataaaaaaattctcaacaaactaggcatagaataaacatgcctcaaaaaataaagtccatatatgtcaaatccacaaatagcattatactgaatggggaaaagtttggaggccttttctctaagaactggaacaagacaaggatatgtacttccaccattcctaatcaacaaagcactgaaagtcctagccagagtaatcaggcaagagaaagaaaaggcatccagattcaaaaagagaaagtcaaattgtccctctttgcagatgacatgatactcatatttagaaaagtcaaaagactccaccaaaaaacccttagagttgttaaacaaattcagttacactacaggatacaaaatcaacatttttttaaagtagtatttctatacaccaataatgaaatagcaaaaaaaagaaaaagcaaaacaaaaacaaaacagaagaacagaacagcaatcccatttccactagctaccaaaaaaattacataggaataaaccaatgaggtgaaatatctctacaaggaaaactataagaatctgatgaaagaaattgaagagaacacatacaaatgtaaagacatcccatgttcatggatcagaaaaaaataatagtgttaaaaggaccatactccataaacaacctaaagactcaatgcaatccctatgaagacactaatgccatttttcacagaatagaaaaaacaatcctacaattcatttgaaaccaaaaaataaccagaatatccaaagcaatcctgagcaaaaataataaagctggaggcatcatactacctgacttcaaattatattacagggctataataaccaaaacacttggcattggcataaaaatagacacatacccaaatggaacagaatagaaaactcaaaaataaatccacatatttacagccaattgattgttgacaaagcaccaagaacatgcactggaaaactgaggttttcttcaataaatagtgctggggaaattgaacagtcacaggcaaaagaatgaaactgaacccctatctctcactgtacacaaaaataaactcaagatggattaaatactcaagtgtaaaactacaaactataaaactcctagaaggaaacataggaaacgcacttccaacagtcgtctaggaaaagattttatggctaagacctcaaaagcacagacaaatggaacaaaaatagacaaatgagactatattaaaatcaaaaacttctgcatagcaaaggaaacaatcaaaagagtaaagaaaccacctgtatgggagaaaatacttcaaactatctgacaatggaataatatccagagtatataagatactcaaacaattcaacaataaaataagaatcccattaagtaagaagtaggcacagaacattaatagataattccgaaaggaagacatgcaaatggccaacaggtacatggaaaaatgctcaacatcactaatcctcaggaatatgcaaatcaaaaccacaatgaaatattatcttactccagttaggatggctatttttttatttttatttttctacccaattgaacagagagtgtctattattaaaaacgcagtaaaatatcacatgctgacaaggatgtggagaaaagagaatgctcatacccttttggtgggaatgtaaattagtacaaccactattaaaaacaatatggaggccgggcacagtggatcatgcctgtaattgcagcactttgggaatctgagacgggcaggtcatgaggtcaggagattgagaccaccctggctaacacagtgaaaccccatctctactaaaaatacaaaaattagccgggcgtgatggcatgtgcctgtagtaccagctacttgggaggctgaggcaggagaatcgcttgaactggggaggcagaggttgcagtgagccaagatcatgccactgcactccagcctgggtgacacagcaagactctgtctcaaataaataaataaataaataaataaataaataaataaataaaaaacaatatggagatttctcaaacaaactaaaaatagaactacaatatgatccagcaatctcactgctgggtatgtattcaaaggaaaagaaatcggtatatcaaagggattcctgcactcacatgtttgttgtagcactattgataatagcaaagatatagaaccaaacttagtgtccattaacagacaaatggataagaaaacatgtggtatatgtatacaatggaatactattcagccataaaaagaatgagagcctgtcatttgcagcaacatggatgtcattatgttaagtgaaataacccaggcacagaaagacaaattattgcatattctcattcatatgtgggaactaaaaagattgatctgataatggtagagagaagaatgatagatactagaagctgggaaggttgactgggttggtagcggagggtgaagagaggtaggttaataagtacaaacatgtaattagataaaaggcataaattttatattttgacagcaaagtagagtgactatgctttacaacaatataatctatatttcaaagtagctataagaaaggacttcctaacccatagaaataataaatcctcacagtaatggacacttcaaaaactttgacttgataattgtgtattccatgcatgtaacaaaatatcacatgtaccccataaatatgtaaaatattatgtatccataaaaagtgaaattttaggctggatgcagtagctcacacctgtattcccagcactttgggaggcagataatgaggtcaagagatcgagaccatcctggccaaaatagtgaaaccctgtctctactaaaaaaaatacaaaaattagttgggcttggtggtgcacgcctgtagtcccagctactcgggaggctgaggcaaagaaatggctgaacccgagagggagaggttgcagtgagccgagactgtgccactgcactccagcctggatggcagagcaagactctgtctcaaaaaaaaaaaaaaaaaaagaaaagtgtgtttttaaatttctaagagcttcataataaatgtgatatatatatatatatatacacacacacacaagaaaaaaagaattcagaattacagggttgaaatgaatcctgctgatatcaattctttgtagaaataccttggacatggattgtattttttccaaatgaaattcctacaaattgccatttctggagtcttgacttcatacagtctataaacacaccattcaatgttgatatttctcaacggatccttagaagtaaacattgcacaaatatattctttactttataatcctcaagtttgcatgtaagtaacttattctgctttagttacaatcaatgacttttgcagcaatttttaatgctgatcacaaattgctcaaaatgaaactaataagatttgaaaatatatattaatatttcctcagtagctcttgctaaatgaaataggcccagtttcttacagatgtctcagtgaatcatcagttttttatcacttaatatttttttctatgaccactccagtttctccatatctctcacaataaaggagcatgtatgattctcaaatcatgatttgtttctaacaaaaggatataaatattctgtctttcatgtaggtctattatatgcatcattgatgatctttttgtttctttttcaaaacaagaagctatttttttttcaaaacaagaggctgtttttctattgttgatagactcttacagtgaattgtatctaccccctcttctggcatgcaactgtaggatgaattggttctagagaaatgctatgtttatttttcaacattgcagatatcgctttgattttttccatatcaatctagtcactgaactgctgttgtattttgagaaagatgatttttttttctttttttcttgagatggagtttcactccaccacacctggttaatttttgtatttttagtagagatggggtttcgccatgttggtcaggctggtcttgaacccctgacctcaagtgatccacctccctcggcctaccaaagtgctggaattacagacgtgagccaccactcccagccaaatttcatttttaaaaagaagtttgctatgccaagaatagctcaggaggtaggggggcagctttaactccttcaatccattaatcaaccactactacacctggtggtagttttacagccactccctgtccaactccaactctcatcttctcctgtacagaaaatctagggctactaggctatatatgtatatacatattcattaagaatgataattctacttggtcatgatgtttaaaagttttaaaaactttaaaatacgctgtcagataagatttgctttgtttttcatgatttcccattacatatatgtttatatgtgaagctggcctataatttttttcttctcctgactgctgtggatgttaaaattatactaacaaatttaatcatgttctttatatcgtatttagtcttaaaataatttgtaaaatatgggaataatatgtttcttgaatgtttggtagaatttgacagagcaggagcatcactgtcttggacaagcactatcattttaaagttccccttgatcaaaaaccacctaaatccaaagggcatcagcctaatggctaaggtcagcatgaacataaaccacaaatgacatctcgaaccagaaacattccaaccctaagataaatccctcccaaaccagagacatgccagccctgaggtaacctcctctctgcccagagagatgtttagccccaaggtaacttcccctctgatcagagacattacaaccccacaataaacttctccccgacacgaaaacattccaagcctgtgataagccctcttgccctaaacacttaaatactctcagtctgtaagagagaatgctcctcactgaaatcggccagaagcccctctcaggtttattctaaaaaataaagttgtctttggctgttgagctgctttttgtgtttctttcctctttctttaactcttacagaatttgcttgggaaaaacatccatgtctggtgtctttggccagggccaaaggtggaagagttaatgttgttattactactagttcaatttattgaccacttggcaacttactcaggttttctactttacttgtctattttattaagtatatttatttaagaatattttatttcatgaaaattgttcatttcatctaaattttccagtttattgaagctgcattcctaaggtttttcacagtattctcaaattctatttatgcactactttatttacagtatgagttctccttcacagttaaatattccctgtattaaaaaaaaattattcagtcctgcaagggctttgtttattttactaaattttcaaagaatcagctttaagtactccatatatttttgtttattttacattaatttcttcacaactttttatttttattttcttctactttttctggattaactctgttgttctttccacagttttcagagataaatgcctaaataactgtgtccctttttcttagttttaaattaaaaagtttaatactataatttccacagtcattgcagatttagacgcattcagttgcattccacaggttgtgaaatgaattctcattgtcttgcaatatatttctaatttttcattattttttcttttacatattagatatttataaataaatttgttttcacacataattttctgtatttttattgctgatatctaatttaattgtattgtgttgagataatgtagtttatagtgacctcacttttcgaaacttgaagagactttcttcctttgttacataatatgtagtcaactttcataacactgtgtgtgtgaagagaagatacagtctctgtttgctacaggggtattaattaagactttgggatgacttgttcaaatcttatatatcctttttaaaatttttatctgagctttcaatttctgatagcattgtactcaaatattctatcatgaggctgaggcaggaggatcacttaaatccaggagttcaagaccagcctgtgcaacaaagcaagacccatctctataaaaaattaaaaattaaaactcatttttccatcatgagtttgaacttatctatttctccctatgatttggttggttctgctttgttctgaagctatctacaaataattgtgaattatatactgtgtggattgttctttttatgaaaatatattgttatttaaaaaaatcctctatagatgtttttgccttaaattctttcttctgaaattaatattttgacacaagttttagtatttgcatagtatatctatatttaatttttctgtctttttaaaagatattttcctataagattagcagttagtttttttaatctaatataatacatttaatattttattagaaaactaataaatttacaatgagtatgattattgaacatatttaaactgatctctatgatcttgttttagtgttctgtttagaattccttctttattgtttttaggggaggatcttatttcttgcttttttgattttcatgtgctctcttttttccttttattaattgtgtaactgtacacacactcagatacgcataatttctgacagagattaaattttagtatgtcctgcctaccaactaaataagacaagaatcttagcatatttaaagtactaatggaaccttcctcttccttctcccaagttctttttcctagaattttagttttacctatatacacatttgtagttttaatgtgctacattcttcatataaagatatatatatatacacacacacacatatatacacacacatatatattcacacacatgctttttatcaaagtttaatgtatacaatgttcataaagtatacatctcacagctgtactgctctataaactttcacaaaccaaccacacatatggaaccaggactgagattaagaatacacaacattaccagctccccagaagctccttcgttccccatacagacccactgctctttttccaaggatgaccacatgctgacttctaccagcataaaattgttttttgtcattttgtactttatatcacttaatcatctacaatgtattttttgtattttttattcaacccattatgtttgtgagaataatttgtatcatatgactgtttcattcattttcattgttttgtagtattccactgtgtaaatgcaaggcagtttatttattaattcaactgttgatgaatatttactacttagagctattatggtcatttccgtatttgttctttttccaacttttggctagtacttgtcttttggtgcacatatatgctttctattgggtgtatacttggaatgactgtgtcatagggtactcagttattgttttaattatactgttaaagtattgtccaatttaacttgtttttaaaaaataaaactgtagatttatttaaaggtagaagtgaagtatattactgatacactttcaaaagctattgattaccgtgctttcttttttaatttactcttcttgctgaagaaatactttgtatttgtggattgtaaactcctcattttttgaatatttgaaaatgtctctattttgctttcactcttaaaggatagcttagctacaagtacatttctaggctggtagtgattttcacataaaacttaattgctttgttcttaagaagttaaaagccaatcttttttttttcctatgcaagcaatctgtttttctttctagtagcttttaaattgcctcttaccattaacttctttctttattccatgatataaccagttaaggattgtgtttattgacctgtttggccctcaatgaagtctttcaatttgaaagatcatcccactcttcaattctataaaattatcagccatatttcctctgtctttaaaaaaaaatgcttattctttgtgggattcctttgatacatgttataatttctcaatctcttcgccaaatactttattttttcatatatattttaaatctgttttttctctttgtgctatatatttcatgaattcctcatttatatcattcaagtaactaatattctgatatttcatttaaatttactttgtctattaatttctttaaattttagctttttagtgtcattctctcaaaggcccttttgtcaatatatacttttgttgatgttgtttgattttctatcaaggacttccagttttaaaaattgtaactctaccctttagttgcatacagtgtgctttgctccaatatccctccataactgagaaaattttgaatcatggaggtaaacacaagcaaaaactccacattggagcccaggatacctttggttctaatttcttctcactgccatgtgtttcttgatttttatccttgctacttattttcttttaaacttttttttttgtatttctatatggactcacagtactatcttggcttatattctgttagttgtatttgtattttgtactagccttcccctaagcttccttacggttggaactgtcttaacatctatagggtcagtatctgggcacttcaaactatacagtaggcactgaagaaagattagtgattagacaaatgaatttttgcaatgtgtataatgtgtttatctaactagaggaaatgtacccagttttctattggtaacatggacatttgaagtcatttatcatatttttgctcttgtaaacagaggtggaacaacaataagccatttcagcatatgagtgatatctgcactatgacataaatcctttatagacaagcaaatgctgagagattttgtcaccaccagacctgcccgacaagggctctggaaggaagtactaaatatggaaaggaacaaccggtaccagccactgcaaaaacactccaaattgtaaagaccatcaattctaggaagaaactgcatcaactaatgagcaaaataacaagctaacatcataatgacaggatcaaattcacacataacaatattaaccttaaacgtaaatggactaaatgctccaattaaaagacacagactggcaaattggataaagagtcaagacccatcagtgtgctgtattcaggaaacccatctcacgtgcagagacacacatgggctcaaaataaaaggatggaggaagatctatcaagcaaatggagaacaaaaaaaggcaggggttgcaatcctagtctctgataaaacagactttaaaccaacaaagatcaaaagagacaaagaaggccattacataatggtaaaggaatcaattcaacaagaagagctaactatcctaaatatatatgcaccatataaaggagcacccagattcataaagcaagtccttagtgacctacaaagagacttagactcccacacaatgataatggaagacttcaacatcccattgtcaacattagacagatcaatgagacagaaagttaacaaggatatccaggaactgaactcagctctgcaccaagcagacctaatagacatctatagaactctccaccccaaatcaacagaatatacattcttttcagcaccacaccacatctattccaaaattgaccacatagttggaagtaaagcactcctcagcaaatgtaaaagaacagaaattataacaaactgtctctcaaaccacagtgcaatcaaactagaaggcaggattaagaaactcactcaaaactgctcaactacatggaaactgaacaacctgctcctgaatgactactgggtacataacgaaatgaaggcaaaaataaagatgttctttgaaaccaacgagaacaaagacataacatactagaatatctgggacacatttaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaagatcagagcagaactgaaggagatagagacacaaaaaacccttcaaaaaatcaatgaattcaggagctggttttttgaaaagatcaaaaaaattgatagaccgctagcaagactaataaagaagaaaagagagaagaatcaaatagatgcaataaaaaatgataaaggggatatcaccaccgatcccacagaaatacaaactaccgtcagagaatactgtaaacacctctacacaaataaactagaaaatctagaagaaatggataaaatcctctacacatacaccctcccaagactaaaccaggaagaagttgaatctctgaatacaccaataacagactctgaaattgacgcaataattaatagcttaccaacaaaaaaagtccaggaccagacggattcacagccgatttctaccaaagatacaaagaggagctggtatcattccttctgaaactattccaaccaatagaaaaagagggaatcctccctaactcattttatgaggccagcatcatcctgataccaaagctggcagagacacaagcaaaaaagagaattttagaccaatatccctgatgaacgtcaatgcaaaaatcctcaataaaatactggcaaactgaatccagcagcacatcaaaaagcttatccaccacgatcaagttggcttcatccctgggatgcaaggctggttcaacatacacaaatcaataaatgtaatccagcacataaacagaaccaaagacaaaaaacacatgattatttcgatagatgcagaaaaggtctttgacaaaattcaacagcacttcatgctaaaaactctcaataaattacgtattgatgggaagtatctaaaaataataacagctacatatgacaaacccacaaccaatatcatactgaatgggcaaaacctggaaacattccctttgaaaactggcacaagacagggatgccctctcccaccactcctattcaacatagtgttggaagttctggccagggcaatcaggcaggagaaggaaataaagggtattcaattaggaaaagaggaagacaaattgtccctctttgcagatgacatgattgtatatctagaaaaccccatcatctcagtcgaaaatctccttaagctgataagcaacttcagcaatgtctcaggatacaaaatcaatgtgcaaaaatcacaagcattcctatacaccattaacagacaaacaaagagccaaatcatgagtgaactcccattcacaattgcttcaaagagaatgaaatacctaggaatccaacttacaagggatgtgaaggacctcttcaaggagaactacaaaccactgctcaaggaaataaaggaggatacaaacaaatggaagaacattccatgctcatggacaggaagaatcaatatcgtgaaaatggccatactggccaaggtaatttatagattcaatgccatcccctcaagctaccaatgactttcttcacagaattggaaaaagctactttaaagttcatatggaaccaaaaaagagcctgcattgccaagtcaatcctaagccaaaagaacaaagctggaggcatcttgctacctgacttcagactatactccaaggctacagtaaccaaaacagcatgatactggtaccaaaacagatatacagaccaatggaacagaacagagccctcagaaataataccacacatctacaactatctgatctttgacaaacctgacaaaaacaagaaatgaggaaaggattccttatttaataaatggtgctgggaaaactggctagccatatgtagaaagctgaaactggatcccttccttacaccttatacaaaatttaattcaagatggattaaggacttaaatgtcagacctaaaaccataaaaaccctggaagaaaacctaggcaataccattcaggacataggcatgggcaaggacttcatgtctaaaacaccaaaagcaatggcaacaagagccaaaattgacaaatggcatctaattaaactaaagagcttctgcacagcaaaagaaactaccgtcagagtgaacaggcaacctacagaatgggagaaaatttttgcaaactactcatctgacaaagggctaatatccagaatccacaaagaactcaaatttacaagaaaaaaaaaaacccatcaaaaagtgggcaaaggatatgaacagacacttctcaaaataagacatttatgcagcctacagacacatgaaaaaatgctcatcatcactggccatcagagaaatgcaaatgaaaaccacaatgagacatcgtctcacaccagttagaatggcgatcattaaaaagtcaggaaacaacaggagctggagaggatgtggagaaataggaacacttttatactgttggtgggactgtaaactagttcaaccattgtggaagacagtgtggcaattcctcagggatccagaagtggaaatatcatttggcccagccatcccattactgggtatatactcataggattataaaacatgctgctataaagacacatgcacatgtatgtttattgtggcactattcacaatagcaaagacttggaaccaacccaaatgtccatcaatgatagactggattaagaaaatatggcacatatacaccatggaatactatgcagccataaaaaatgatgagttcatgtcctttgtagggacgtggatgaagctggaaaccatcattctcagcaaactgtcgcaaggacaaaaaaaccaaacaccgcattttctcactcacaggtgggaattgaacaatgagaacacttggacacaggaaggggaacatcacacactagggcctgttgtggggtggggggaggggggagggatagcattaggagatacacctaatgttaaatgaccagttaatgggtgcagcacaccaacatggcacatgtatacatatgtaacaaacctgcacgttgtgcacatgtaccctagaacttaaagtataataaaaatatatatataaaatcattgtattaatctgtgaaatatttttaaagaatgttcaacctgttaatatccagttagagcaaggatgtagaaaaactagtacaatattaaattaataaaaatatatcaaagcaaggaaaagtttgtgttttgatctagtaacttcattttttggaattcgtaaaataattctggatattgagaaatactttattgaagtatggtatttaataataaaaaacaaatttagaacaataaaaggttaagaaaaatataatttattcagttaatggtatagtttaaaatcttaaaagtgattgttacaaaactaaattgtatcaaaagctaacctactcatccagaagaaagccacaattaaattgcaacatgaaacaatacttttagtatacaaatattatggcactaaaacagcgatacgcattttttaaaattattattatactttaagttctgggatacgccaggtgcggtggctcacgcctgtaatcccaacactttgggaagccaaggcaggtggatcacgaggtcaggagatcaataccatcctggctaacacagtgaaaccccatctctactaaaaatacaaaaaattagccgggcgtagtggtggcaggtgcctgtagttccagctacttgggaggctgaggaaggagaatggcatgaacccgggaggtggagcttgcagtgagcagagattgcgccactgcactccagcctgggtgacagagcgagaccatctcacagaaaaaaaaaaaaaaaaagttctggtatacatgtgcagaacatgcagctttgttacataggcatacttgtgacatggttgtttgatgcacccatcaactcatcatctacatcaggtatttctcctaatgctatccctacccttgcccccaacccccaacagggtatgtgatgttcctttccctgtgcccatatgttctcattgttcaattcccatttattagtgagaacatagggtgtttggttttctgttcctttgttagtttgctgagaatgatggtttccagcttcatccatgtccctgcaaaggacagcaactcatccttttttatggctgcatagtattctatggtgtatatgtgccacattttcttgagccagtctatcattgatgggcatttgggttggttccaagtctttgctattgtgaatagtactgcaataaaaatatgtgtacatgtgtttttatagtagaatgatttatgatcctttgggtatatacccactaatgggattgctgggtcaaatggcatttctggttttagatccctgaggaattgccacattgtcttccacaatggttgaactaatttacactcccaccaacagtataaaagtgttcctatttctccacatcctttccaccgtctgttgtttcctgactttttaatgattgccattctaactggcatgaaatggtatctcattgtgggtttgatttgcatttctctaatgatcagtgataacaagctttttttcatgtttgttggctgcataaatgtcttcttttgagaagtgtctgttcatatcctttgcccactttttgatggggttgtttttctcttgtaaattcatttaagttctttatagattctggatattagccctttgtcaaatggatagattgcaaaaattttctcccattctgtaggttgcctgtttcctctgatggtagtttctttcaccgtgcagaagctctttagtttaattagatcccatttgtcaattttggcttttgttgccattgctttggtgttttagtcatgaagtccttgcccatgcctatgtcctgaatggtactgcctaggttttcttctagggcttttatggttttaggtcttacctttaagtctttaatttatcttgagttaatgtttgtattaggtgtaaggaaggaatccagtttcagttttctgcacatggctagccagttttcccaacagcttttattaaatagggaatcttttccccattgcttgtttgtgtcaggtttgtcaaagatcagatggctgtagatgtgtggtgttatttctgaggcctctgttctgttccattggtctatatatctgttttggtaacagtatcatgctgtttttgttactgcagccttgtagtgtagtttgaagacaggtagcattatgcctccagctttgttctttttgcttaggattgtcttggctatatgggctcttttttggttccatatgaactttaaagtagtttttttctaattctgtgaaaaaagtcaatggttgcttaatgggaatagcattgaatctataaattaccctgggcagtatggccattttcaagatattgattcttcctatctgtgagcatggaatgattttctgtttgtttgtgttgtctctgatttccttgagcagtggtttgtagttccccttgaagaggtccttcacatcccttgtaacttgtatttctaggtattttattctctttctagcaattgtgaataggagttctctcatgatttggctctctgtttgtctattataggtgtataggaatgcttgagatttttgcacattgattttgtatcctgagactctgctgaagttgcttatcagcctaaggagattttggggctgagatgacagggttttctagatatacaatcatgtcatctgcaaacagagacaatttgacctcctctcctcccacttgaatatactttatttctatctcttgcctgattgccctggccagaacttccaatactatgttgaataggagtagtgagagagggcatccttgcctgtgctggttttcaaagggaatgcttccagcttttacccattcagtataatattggctgtgagtttgtcatatatagctcttattattttgagatatgttccatcaatacctaatttattgagagtttttagcatgaaggggtgttgaattttatcaaaggccttttttgcatctattgagataatcatgtgtttttttttcattggttctgtttatgtgatggattccatttattgatttgcttatgttgaaccatccttgcatcctggggtgaagctgacttgattgtggtggataagctttttgatgtgctgctggattcagttttccagtattttattgagaattttcacatcgatgttcatcacggatattggcctgaaattttcttttttttgttgtgtttctgccaggttttggtatcaggatgatgctggcctcataaaatgagttattttatgataatttcttttctattgtttgaaatagtttcagaaggaatggaaccagctcttctttgtacctctgatagaatttggctgtgaatctgtctggtcctgggcttttttttggttggtaagctattaattactgcctcaatttcagatcttgttattgttctgttcagagattcgactttttcctggtttagtcttgggagggtgtatgtgtccaggaatttatccatttcttccagattttctagtttatttgcatagaggtgtttatagtattctctgatggtagtttgtatttctatagtattctctgatggtagtttgtatttctgtgggatcagtggtgatatcccctttatcattttttattgtgtctatttgattcttctctcttttcttctttattagtctggctagtggtctatctgttttgttgatgttttcaaaaaaccagctcctggattcattgattttttgaaaggttttttgtgtctctatctccttcagttctgctctgatcttagttatttcttgtctcctgttagcttttgaatttgtttgctattgcttctctagttcttttcattgtgatgttagggcgtcaaatttagatctttcctgctttctcctgtgggcacttagtgctataaatttccctctaaacactgctttagctgtgtcccagagattctggtatgttgtgtctttgttcttattggtttcaaagaacttatttatttctgccttaatttatttacccaatagtcattcaggagcaggttgttcagtttccatgtagttgtgcggttttgagtgagtttcttaatcctgagttctaatttgattgcactgtggtctgagatactgtttgttattatttccatttatttgcatttgctgaggagtgttttactttcaattatgtggtcaattttagaataagtatgatttggtgctgagaagaatgtatattctgttgatttgaggtggagagtttggtagatgtctattaggtctgctcggacctgagctgagttcacatcctgaatatccttgttaattttctgtctcgtttatctgtctaatatgacagtggggtgtaaaagtctcccactattattgttttggagtctaagtctttttttaggtctctaagaacttgctttatgaatctggatgctcctgtattgtgtgcacatatatttaagatatttaactcttcttgttgcattgatccctctaccattatgtaatgcccttctttgtcttttttatctttgttggtttaaagtctgggttatcagagactaggactacaatccctgctttttttttttttttttttttttttgctttctatttgcttggtaaatctttctcaatcccactatttttagcctttgtttgtctttgcatgtgagataagtctcctgaatacaggacacctatgggtcttgactctttatccaatttgtcagtctgtgtcttttaattggggcatttagtcaatttacacttaaagttattgttacatgtgaatttgatcctgtcatcatgatgctagctggttattttgcccattaattgatgcagcttcttcacagtgccgatggtctttacaatttgatatgtttttgcagtggctggtaccagtttttccttgccatgtttagtgctttcttcaggagctcttgtaaggcagacctggtggtgacaaaatctctcagcatttgcttgtctgtaaaggattttatttctccttcacttatgaagcttagtttggctggataaaaaattttgggttgaaaattcttttctttaagaatgttgaatatcagcccccaccctcttctggcttgtagggtttctgccaagagatcccctgttagtctgatgtgcttctctttatgggtaaccccacgtttctctctggctgctcttaacattttttccttcatttcaaccttggtgaatctgacaattatgtgtcttggggttgctcttctcaaggattatctttgtggtgttctctgtatttcctaaatttgaatgttggcctgccttgctaggttggggaagttctcctggataacatcctgaagcgtgttttccaacttggttccaatctccctgttactttcaggtacaccaatcaaaaaagtttggtcttttcacatagtctcatatttcttggaggctttgttaattccttttcattcttttttctctaatcttgtctttatgctttatttcattaagttgatcttcaatctctgatatcctttcttccacttgatggatttggctattgatacttgtgtatgcttcacaaagttctcatgctgtgtttttcagctccttcaggtcatttatgttcttctctaaactgcttattccagttagcagttcctagggagacctaggggaatcttttatcaaggttcttagcttccttgcatttggttagaacatgcttcttttgctcagaggagtttgttattacccaccttccgaagcctacttctgtcaattcatcaaactcattctctgtctaattttgttcccttgctggcgaggagttgtgatcctttggaagagacattctggtttttggaattttcagcctttttgagctgctttttcctcatctttgtggatttatctacctttggtctttgacgttggtgatctttggatggggtttttgcgtgggtgtcctttttgttgatgttgatgctattgctttctgtttgttagttttccttctaacagtcaggcccctcttctgcaggtctgctggagtttgctggaggtccactccagaccgtttgcctacgtatcaccagtggaggctgcagaacagcaaagagtgctgcctgctccttcctctggaagctttattccagaggggcacctgccagatgccagccagagctctcctgtatgagatgtctgttgacccctgctgggaggtgtttcctagtcaggaggcaccgggttcagggacccacttgaggaggcagtctgtcccttagcagagctcaagctctgtgctgggagatccactgctgtcttcagagccagtagacagaaacgtttaagtctggtgaagctgtgctcacagctgccccttcccccaggtgctctgtcccagggagttgagagttttatttataagcccctgactgtggcttctgcctttctttcagagatgccctgcccagaaaggaggaatctagagaggcagtctggctacagaggctttgctgcactttggtgggccccacccagtttgaacttccaggtggctttgtttacactgtgaggggaaaactgcctactcaagcctcagtaatggtggatgcctctcacccacaccaagctggagcatcccaggtcaacttcagactcctgtgctgacagcgagaatttcaagccatggagcttgttgggctccatgggggtgggatccgctgagctagaccacttgactccctggcttcagccccctttccagcggagtaaatggttctgtcttgctagcattccaggtaccactgaggtatgaaaaaaactcctgcagctaggtcagtgtctgcccaaacagctgcccagtttcgtgcttgaaatctagggccctgggagtgtaggcacccaaaggaatctcctgatctgtaggttgcaaagaccatgggaaaagcaaagtatatgggccagagtgcactgttcctcaaggcacagtccctcatggcttcccttggctaggggagggagttacctgaccccttacacttcccgggtgaggtgatgccccaccctgcttcgggtcaccctccatgggctgcacccactgtgtaaccagtcccaatgagatgagtcaggtacctcagttggaaatgcagaaatcacccaccttctgcattgatctccctgggagctgaagaccggagctgttcctattcagccatcttctattcctcatgatacacatttttaatataatggttgtaatctaattataactttataagataaaatacttataaagaaatacttcataaagtacaatatatcaaatagtactatttgtatttgtataatgagattataaatttatattttctaatctttttcttaaaaaaaggatactatttacatcatcacaacaatgaccctatgaagaacacacattaaaaaagctgataggttagcatgataaaaaataaagatttgaattttaatcacaaattttgtagagagtagttgttacctgaggattatgatacagaggttagcatgtgcatatttctgtagattttggttttcagattctctgacttgtgatctcaaagattccttatgataaataaaataattaagcaaatgaaaaatgaagcaaataaaaatggtaatataactttttacatagcatgtatgttacacattagatatagcataatagactatttcagaggaatatccggctaataaatcaaaatagtaattatataaatggtttaaattaggtcactggagggaaaaataaaaatcacaaaatagattcatttttacctcaacaataaacgagttcatcaatatgttacactaggttatgaaggactattagatcatatataagggctgtttataaaatgtcaacaaaaaaatcaaatcacaggtttttagaagtagaagctggtcaatacctcaaagaaaatctgtattacaactgaaataagaattaatattcttcccattaaatcacaaagcctttttatttcattcctataaaatcacatgaatgtgtaattgaatatcacaatcctttataacctcaggcaagcttcttaatgtctcagaaccatactctgttatcagtttctcatattgatagcatttatgttattgccagcttgggctattaaaacagtattccaataaatattattgttcacatagcttttgcaattatatctccactttagatatttgaaggtgaaattaatgcgagccaaaatgggctcaatgtgactgtcaggaaaaatgatatctttgtaatataatcaatttttctttgattattagtacagttgagcatatatatgtttatttatataaatcagggcatttcttaatatattcattttctatttcagatttgcctatttttctagtgaaatttttttattgatttgtaatattttgtatataaaacctgaaacactttaaacaccatatgtgctatatgcatggtattttctctgtgtctgcagcttatcttttcacttaatgtttatgttatcttcttcatatcaagttttaaatgctgacaaaataaaatctgtcaaattttccttagggcctcaagctcttacgatgatcaaaatgaccaatctttagtgacttttgtaactatacactacccatctgactccagattatatgcttttaaccacttcactattcttgtttgaaacttgagaatagggtagtagttaaaagcatcaaatctggagccagattatgtaggtttaaatcctggggcaccctcatctgactagctctacgacatgaaatgagttactcaactttcctgtgtacagtttcttgtttatcagttgagtaaatataattaaagagattagattagggcctggcacacaataagtgctaaataaacatttgttattatttgttccctccaaacatgtctgtttctctaagtagatgtttttgtataaattccaacaatgtgatgtttatatcaagattttattccatttttctcatttattaataactgtaagtgagttcctactatgtacttctctggcaccaagccaggcacaaaaaacagagtaattaataaatattagggttgggtgccatggctcacacctgtagtctcaacacctgggaggccaaggtgggagcattgtttgaggccaggagtttgagaccagacttagcaacacagcaagaccctgtctttacaaaatatttaatcattttaaaataattttaaaaaatcaacactaatggttgcttttctgatggtgcttgctgtctaatacaagaaagtaaaattgtaatgtgacaattgacagaaaagaaagataaaaatgttatgatagattgatctgttcaagactggtaagttgctttcctgaagaaataatgcttaaattgaaatataaggaataaataaaaatttctctggagaaaagggaaaggaagttcatttgtacaaatttagcaaggtaaaattaataaaattacattttcaatttattttgaaattagccttgcaaatacgaagtaatttttaagcaaaagttctaaatattgctttgctattccaagactaaataattaagaactcttccaattccagttatttgtgtgaattacataatgcaaacatttgtaaagaacagattgcttttagaaagtctgatcttgaatttatttttcttcgtttactctcttgcagacatatccattgtatgctttcaaaacattcttatatttttccagaatataaaaacactgtgtgcaaatgttcaatatacatgtagctggaaatagataacatttgggtggatggcaatctaatgtatacaaagagtagattcacagctgtgtatttgccagattagaaataaggctagacttctgatttctggagaattttggtaaagcaaaatataagagaaagaggtttagacttgttcagtgctatctaaaatagaaactcttgcagaaaaagaattacatttacttaatccatcctttccataattattcacactgaaactactgaaatagtatgtaaaatattaatagtacattgtttgaaaacctatacagtcaaccctctttctcctggggttctgcatccatggctgcttctgtattgaacacgtacagacatttttcttgtaactatttcctaaaaaatatagtataactatttacacagcatttacagtatattagttattataagtaaccctgtagcaatttaaagtatacagggagatatgcataggttatatgccaatagtacactattttatataaggaacttgaacatccatggattttggcatctgcagaaggtcctggaaccaaccccccatggataccgagggatggctgtataatatggattaggtttttttttcctaaagttcttcaaaagctcttgacctcaagctttttaaataaaacctacataaaatattctcaattaaaataactgtaaatatattttggagcagtacaaattgcttggcattttacttttaaaacctaaaggctgaattctatgttaatagattacaacataaaacagattcacttatatgaaacaagcaagttttttctcatattgtttgcaccaaagaaagttgcattgatgaatagaaaaaaaatagctttattcccctacttcctcaacacaataagaatgaaagacaactaaaattaaacttgtggtggagccaagatggccgaataggaacagctccggtctacagctcccagcgtgagtgacgcagaagatgggtgatttctgcatttccatctgaggtactgggttcatctcactagggagtgccagacagtgggtgcaggacagtgggtgcagtgcaccatgcacgagccaaagcagggtgaggcactgcctcactcgggaagcgcaaggggtcagggggttccctttcctagtcaaagaaaggggtgacagacgtcacgtggaaaatcaggtcactcccaccctaatactgcacttttccaatgggcttaaaaaacagcacaccaggagattatatcccgcatatggctcagagggtcctatgcccacagagtctcactgattgctagcacggcagtctgagatcaaactgcaaggccacagggaggctgggggaggggcgcctgtcattgcccaggcttgattaggtaaacaaagcagcggggaagctcgaactgggtggagcccaccacagctcaaggaggcctgcctgcctctgtaggctccacctctgggggcagggcatagacaaacaaaaagacagcagtaacctctgcagacttaaatgtccctgtctgacagctttgaagagagtaatggttctcccagcacgcagctggagatctgagaacaggcagactgcctccttaagtgggtgtctgacccccgagcagcctaactgggaggcgccccccagtaggggcagactgacacctcacacggccgggtattcctctgggacaaagcttccagaggaacgatcaggcagcagcatttgcgggtcaccaaaatccgctgttctacagccactgctgttctgcagccaccacggctgacacccaggcaaaaagggtctggagtggacctctagcaaactccaacaaacctgcatctgagggtcctgtctgttagaaggaaaactaacaaacagaaaggacatccacaccaaaaacccatctgtacgttgccatcatcaaagaccaaaagtagataaaaacacaaagatggggaaaaaacagagcagaaaaaccagaaactctaaaaagcagagcacctctcctcctccaaaggaacacagctcctcaccagcaacggaacaaagctggacggagaatgacattgatgagttgagagaagaaggcttcagacgatcaaactactccgagctacaggaggaaattcaaaccaatggcaaagaagttagaaactttgaaaaaagattagacgaatggataactagaataaccaatgcagagaagtccttaaaggagctgatggagttgaaagccaaggctcaagaactacgtgaagaacgcagaagcctcaggagccgatgcgatcaactggaagaaagggtatcagtgatgcaagatgaaatgaatgaaatgaagtcagaagggaagtttagagaaaaaagaataagaagaaacgaacaaagcctccaagaaatatgggactatgtgaaaagaccaaatctatatctgattggtgtacctgaaaatgacggggagaatagaaccaagttggaaaacactctgcaggatattatccaggagaacttccccagtctagcaaggcaggccaacattcagattcaggaaatacagagaacaccacaaagatactcctcgagaagagcaactccaagacacataattgtcagattcaccaaagttgaaatgaaggaaaaaatggtaagggcagccagagagaaaggttgggttacccacaaagggaaagccatcagactaacagtagatctcttggcaaaaactctacaagccagaagagagtgggggccaacatttcacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcactaaacatggaaagcaacaaccggtaccagccactgcaaaaacataccaaaatgtaaagaccatcaaggctaggaagaaactgcatcaactaacgagcaaaataaccagctaacatcataatgaacaggaccaaattcacacataacacttaactttaaatgtaaatgggctaaatgctccaattaaaagacacagactggcaaattggataaagagtcaagacccatcagtgtgctgtattcaggaaacccatctcacgtgcagagacacgcatgggctcaaaataaaaggatggaggaagatctaccaagcaaatggaaaacaaaaaaaggcaggggtcgcaatcctagtctctgataaaacagactaaaccaacaaagatcaaaagagacaaagaaggccattacataatggtaaaggaatcaattcaacaagaagagctaactatcctaaatatacatgcacccaatacaggagcaaccagattcataaagcaagtccttagtgacctacaaagagacttagactcccacacaataataatgggagacattaacaccccactgtcaacattagacagattaacgagacagaaagttaacaaggatacccaggaattgaactcagctctgcaccaagcagacctaatagacatctacagaactctccaccccaaatcaacagaatatacattttttttcagcaccacaccacacctattccaaaattgaccacatagttggaagtaaagcactcctcagcaaatgtaaaagaacagaaattataacaaactgtctctcaaaccacagtgcaatcaaactagaaggcaggattaagaaactcactcaaaactgctcaactacatggaaacggaacaacttgctcctgaatgactactgggtacataacaaaatgaaggcagaaataaagatgttctttgaaaccaacgagaacaaagacacaacataccagaatctctgggacacgttcaaagcagtgtgtagaggaaaatttatagcactaaatgcccacaaaagaaagcaggaaagatccaaaattgacaccctaacatcacaattaaaagaactagaaaagcaagagcaaacacattcaaaagctagcagaaggcaagaaataactaaaatcagagcagaactgaaggaaatagacacataaaaaaactttcaaaaaattaatgaatccaggagctggttttttgaaaagatcaacaaaattgatagaccgctatcaaggctaagaaggaagaaaagagagaagaatcaaatagatgcaataaaaaatgataaaggggatatcactaccaatcccacagaaatacaaactaccatcagagaatactattaacacctctaagcaaataaactagaaaatctagaagaaatggataaattccttgacacatacaccctcccaagactaaaccaggaaaaagttgaatctctgaatagactaataacaggctctgaaactgtggcaataatcaatagcttacaaaccaaaaaaagtccaggaccagatggattcacagcggatttctaccaaagatacaaagaggagctggtaccattccttctgaaactattccaaccaatagaaaaagagggaatcctccctaactcattttatgaggccagcatcatcctgataccaaagcctggcagagacacaaccaaaaaaggtaattttagaccaatatccttgatgaacattgatgcaaaaatcctcaataaaatactggcaaaccgaatccagcagcacatcaaaaagtttatccaccatgatcaagtgggcttcatccctgggatgcaaggctggtttaacattcacaaatcaataaatgtaatccagcatataaacagaaccaaagacaaaaaccacatgattatctcaatagatgcagaaaaggcctttgacaaaatccaaaaacccttcatgctaaaaactctcaataaattacgtattgatgggacgtatctaaaaataataagagctatctatgacaaacccacagccaatatcatactgaatgggcaaaatctggaagcattccctttgaaaactggcacaagacagggatgccctctctcaccactcctattcaacatagtgttggaagttctggccagggcaatcaggcagcagaaggaaataaagggtattcaattaggaaaagaggaagtcaaattgtccctgtttgcagatgacattattgtatatctagaaaaccccatcgtctcagcccaaaatctccttaagctgataagcaacttcagcaaagtctcaggatacaaaatcaatgtgcaaaaatcacaagcattcttatacaccaataacagacaaacagagagccaaatcatgagtgaactcccattcacaattgcttcaaagagaataaaatacctaggaatccaacttacaagggatgtgaagggcctcttcaaggagaactacaaaccactgctcaatgaaataaaagaggatacaaacaaatggaagaatattccatgctcatgggtaggaagaatcaatatcgtgaaaatggccatactggccaggtaatttatagattccatgccatcctcatcaagctaccaatgactttcttcacagaattggaaaaaactactttaaaggtcatatggaaccaaaaaagagcccgcatcgccaagtcaatcctaagccaaaagaagaaagctggaggcatcacactacctgacttcagactatactccaaggctacagtaaccaaaacagcatggtactggtaccaaaacagagatatagatcaatggaacagaacagagccctcagaaataatgccacatatctacaaccctctgatctttgacaaacctgaaaaaaacaagcaatggggaaagcattccctatttaataaatggtgctgggaaaactggctagcgatatgtagaaagctaaaactggatcccttccttacaccttatacaaaaattaattcaagatggattaaagacttaacatgttagacctaaaaccataaaaatcctagaagaaaacctaggcaataccattcaggacataggcatgggcaaggacttcatgtctaaaacaccaaaagcaatggcaacaaaagccaaaattgacaaatggggtctaattaaactaaagagcttctgcacagcaaaagaagctaccatcagagtgaacaggcaacctacaaaataggagaatattttcgcaacctactcatctgacaaagggctaatatccagaatctacaatgaactcaaacaaatttacaagagaaaaacaaacaaccccatcaaaaagtgggcgaaggatatgagcagatacttctcaaaagaagacatttatgcagccaaaaaacacatgaaaaaatgttcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtagtgattccacagggatctagaactagaaatatcatttgacccagccatcccattactgggtatatacccaaaggattataaatcatgctgctataaagacacatgcacacatatgtttattgcggcactattcacaatagcaaagacttggaaccaacccaaatgtccaacagcgatagactggattaagaaaatgtggcacatatacaccatggaatactatgtagccataaaaaatgatgagttcatgtcctttgtagggacatggatgaaactggaaaccatcattctcagcaaactctcgcaaggacaaaaaaccaaacactgcatgttctcactcataggtgggaattgaacaatgagaacacacggacacaggaaggggaacatcacacttcaaggactgttgtggggtgggggaaggggggtgggatagcattaggagatatatctgatgttaaatgacgagttaatgggtgcagcacaccaacatggcacatgtatacatatgtaacaaacctgcatattgtccacatgtaccctaaaacttaaagtgtaataataataaaattaaaaaataaataaataaataaaattaaactttaatgaccttttgatctactctcatttaatctgcttttatattcctcatatttggcagaacccacaataatcagatgagattggctaagagtaaatccatatgtctctttctttttgaaagatttactagttcacatttttaaaaagttagaattagaaattttagtcattagaaagtaatgaagaaataatgacacccattggagtaattatataaaaaaagcaaatgtaaaaatcctagaaaatatatgcccaataaaatgagaatgcttaaaaaaatgaggaaaaaatgccgagcaaaatgagagatgagggacataaattacaaagtaaaggtgctggggggacattcatctacattgagtgctgaatccacagattacgggaaaaatcactgaaaactgcattatccattttttggtgtttcttggtgctgactggaaatctgtaatgtatgtagatgccaaccaacaaagaaacaagatgggagaagagtaagggaacgaacacgtcaaataccacaggcacggtgctggatcctttacagacattataatgtggtcaaaattacatgaaacaaattgtcattttgttttccaattgtttgatttttggcatttcaatacttgaaattaaaaatgcttttttattgttaattttagcttcataaataatgttagtaaaatatttcaaatgagtgcctttggaaagctttttcaattccaggaaaggctatgattttttgccttctataaattataaccttcagcaaaaggtagtaactactgcattaccaaagggcactcatccagaaaatctggattctggagaacaccatcatcttagaaaaaccatttaatgactcaaagtccggcaatatatcttttaaaataataccacataataaagaatattaatcagacatttttctagcaagaatacatgcatttcttttgatcttctacatgaaaatgcacatactggatggacaaatgacagtaaaatactgaaaattctaacttcaaaatgggtttcatttatcaatagaacataatattggctttgattttcagattgcctactggggaataaaattaagttatcatattctccatcagagatcttagtctaagttcataattttttttgaggtaattgtttcaataattatttttttaactgaccttcaaaaagtgaaatcttctatcattcctaacttccattctgcagtttagagagtaatgaaagcagttaacatccccacttaccccagataattgtctaaaaaatcccagccaaatatgtgaaaaggacaagccatttttagaaactcatgtaatttaaatttattttctcatttgatattttgcagttatgtttaagtcacatgctagaagagttttggtattttttccagaaaataaaaacactttgtttggagtactaacataaatatagctgggagaaataacctgtaaactgaaagcaaatctaatctatataaatatcagtttgttgttctgtttcccttgtataatatagtaaggctttagacctcactttactatactgatgttaaggggtcaccatacagcaaaacactaagcattttacatttcagctttttcagaaataacgttgtattcatttcacagtgaataagaagataaggatgatatcaaagaacatcacagaatataacaagaaattgcattttacaataggtaagaaaatgttccctagaatatttacacttaaaagaaaaatcttgctccattgatataacatctcaaggaagaactagcaatagaagaaaattgtgctaaactttagaccctgttgtagcaatatttaaaatgctgcctcatttcctcacaagctagagatgttactttgctccaacttattatttcttctttttcaagtaaatgttgctgaaatagatttgtaaagatttctgattaacccaattactttaaccccaactcactcttcaagacacaagtctaacttttttgaagataaagtaacataagactacaaacatttttccggttttagcagttgccaaaattgtgatcatgggccaggtatttgttctttccatatctcagttgcctccaatataaatggaacttaacaatagtagatatcatctatagcttttgagtggattcaatagcacgtgtacacacacatacacacacatacactcacatacacttaaagactatgccttcacatagtgaaggcaattgccttcgtgtgatagtctttaagtaaatctaaccaatgcttgattgcaataatgattaatagtggtagttttagttgtgtgagttaagacaagatgatcacgtaagtagctataacaaatatttagtgaacagttactatgtgcaagacactttttatgcttgacacgtgtcattttatttaatcatgtaacaacacaataaggtaaatgttattataattatccccattttatggataaggagagctgggatacagagattgagacagacaaatgaatataacaccagagagaaataagagagacctgttttagaaggcaagaaaacaagttaggaaataaaaacgtatctttcagatgctatataaaaatggtctagattcgaagcaatttgttaatcaagtgtaaaacataagggtaattaatgaaaataatattttcatcattagttttaagtttttaaaggtttttaagtatgttaagtattaagtatttttagttttaagtatttcaagtagttttaagtatttcaagactttaagacaagactgattttttggactcctagatacataattatgtgagttaaaattgggattatccatttttataagaaactactcaaaaattaaaatataaaaattttggctgctagccaatccaaaaactttcaatccttttaccatgtcataaagcaaatgctaactcctacttcctaagcatcccgacagggccaaactcttcatgctttcaaggatgttatctataagcatggtccacaggatagtttaaaatttctgattctgcttccaaatttgaactgcactcacatctcactcactctcatctcattttccccagcactttcttctccctcatcttcctatttctgaatggttccctggccagttctccagccaaaaagcctttggttacctagttttgctaaggactttcacaactgaggccaagtggcagtgtaattgcctgatgggtttgtatgatagttacatttcttctatatttttattttcaacttcagtagcattgagaaatttcatattagtatatttatgtgcaattggcattctttatattctattcatatcccatttatattatttcgtgtactgtattttttccattagactttttgtcaaggcagcctgaaacctagtaatgataataaatctgtgaccccaagagggtgggatgaacctatattacttttatttctcttgtgtcttcctggtgaaattgcctttacaaaaattatgacagtgaaataaatctgacctaagtgactccatcttgcttctaacccccaagctgcccttgcacattcctgggtgtgggcctagctaactacgggagaaacttagtttatggcctaactttggaacaaagatgataacagctccttcttggacaaaacccctcattgcttggagatcagacttcctttgtaaaactaacaaagtagccacaagattagaaattatttctcagaaatcatgcagccagaggccacaagattcctaacttctctgttcctgtgaataacattattattgtaaaacttaaggttgatttttgaggtattttttaggccctgccttctgatggaccaggtggtgccacccagactggtaaaccaacttacctgatctcacggcccccaggaactgactccatgcaagaagataagctttgactgcctataatttcatccctgacccaactaatcagcattccccatcccctagccctgtgtctgccaaactactcttaaaaatccgagcctctggctgggtgcagtggctcatgcctgtaatcccaacactttcagaggctgaggcaggcggatcacgggttcaggagattgagaccatcctggctaacacggtgaaaccttgtctctactaaaaatacaaaaaaaaattgtcaggtgtggcggcatgcacctgtagtcccagctgcttgggaagtataggcaggagaatcacttgaacctgggaggcagaggttgcagtgagccgagatcgtgccactgtactgcagcctgggcgacagaaggagactctgtctcaaaaaagaaaaaaaaaaaaactgagcctccaaattttcagggaggctgacttgagtaataaaactctggtctcttgtttagctagctctatgtttattaaactctctattgcaataacactgtctcagtagagcagcttttctgggcagcagacaagataaacccattgggcaattacactgccacttggcatcagttgtgaaagtccttagcagaaccaggtaactaaagccccagctttttggctggagatccggccagggccagggaaccatcagaagtaggaagatgagggagaaagaagtgctagggaaaatgacactgcaatgttgattgtgaacccctggcatcaactccaaaccatgcttatgtggatctgaatgtaatcagcctaatcgaaggaacagaccacctctcaggtcagagactaataaccactaacattggacacattggaataacacagcaaatgctttaaaaattgaactgacattggaaccacagacaataggatgctagatgtaattatcaactgaacttaagcatgttgattgcctgataaaacaacaatataagcattctccatagaaggtaaacaaagcctcttaatataatattaaatacctgtagatactttagtaggcagaataatggctccaaagatacccagattgtcatcctcaggacctgtgaatatgttaccttacatggcaaaaatggatttgcagatgtgattaagctaaggacctaaagatagggagcttatcctgaattatctggatggatccatagtcatcacaggtgaaagagagaggcagaagagtaggtcagcgtgatgagttgtgagaactcaaccagccattgttggtttggatgatggaggaaagaggccaagagccaaggagcacacaaaagtgggaaaaggaaatagattcccccctgcagtctctaggaaggaacacagccttgctgacaccttgatttagtcctgtgtaactagacttctagactgcagaactgtaagataataaatgtgtattattttaaacaactaagactgtaacttattattgcagcaataaaactgaaaagtcttttaaatgccactaaaattgataagactctagcaagattgtcaaagaaaaaaaggagaaagccaaattacaataatatgaatgaaatagggaattatcaccatagcatcataggcattaagaggatactgagagaaaactagaacaattttatggccataattttacttcttaaataaaaagaaccaaacactttaaagacacagattaccaaaattcaattaagaagaaatatatactctgaatatttttaaaaccatgaagggacttgaattcataatttaaatcttctcaaaaatgtcatctttggtgatgatgtcaattgttagtttctaccaaacatttagaagtaatgccaactctacaaaatctcctccaaaaaatagaagaggtaacactttccatttcattttatgagaccagcattacactgatatcaaagccaaagatagtataaaaatgaagatgaaggaggaggaaggagaggaatgagaggagggagaggagggggaggagggggaggaggggaagaaagggggaaaaggcggaggagaggaggaagaggataaaaaaatataaacatcatatattagcatgtgtgtatgtatgtctgtaccacaaccaaatgggatttattctaggggtacaagtctggccaatattttggcatcaatgaaatctgtattaatagtctaatgaaaaatgtaataattatttctttttttcaggaaaaatatgtaaaattcagtgttcattcattatagaaattctcagcaaagtaggaatggtaaggaacatcctcaacctggtgaagaacatctaagaaaaacctgtgactaatatcatacttaatgataaaagaatattggcttttctcttaagattgggaacaaggcaaggatgttcactctaacttctcccattcaatcttgtgctagaaattctaactactacaataacaattttaaaatataagaaataaaaacttaaaatgaagaaatataactgtccctatttacaagtgatatgatcatctacatagaaatcccaagaaatccacaaaagactcgtcaacccaatggagtgcagcaaggttatagtgaggtaggagaccagcaggacttattcctggtctcaacaggatgaagtgaagaaaccagcaagaatcagtagatgacaacagaaccaacctctaggtgtccccactgctcatcagcataagacactcccaccagtgccctgacagtttacaaatgcccagcaacacccagaagttactggccgttttctagagagttctgagtaacccactccttaacatgcatgtaattaaaagtgggtataaatactactagccaatagtccacatgctgctactgtggatgctcaggctctgggttagtgctgctccacaaggagctgtcattctgcggtacactgacacttcaataaataggctttctttcaccactagctcactcttgaattatcttctgagcaaagtcaagaacccttctggactaagccccaattttggggctcacctgccctgcatcaacaggatacaagatcaacatacaacaaaacaattttatttctgcacaatatgaatgtaactataaactgaaagtttaaaagaaataccatttacaacacctcaaaaatttggtataaatctggcaaaatgtgcagaatctgtatgcagaaaacaacaaatgctgattaaaagatatcaaagggccaaataaattgagacatatgatgttcatagattgaaagactcaacatagtaaaatgccatttcttcccaaatttagatttattgaaattccaaacaaaatcccagcagaactttatagatatagataagccaatttgaagattaatatggaaattcaaaggaattatcatagctgaaagggttttgaaaaagaagaataaaattggaggaatcaccctacctaaatttaaaatttactgtaaagctactgttatcaagacaatgtggtatagatcagctgatcaataaagcagaagatagtctagaaatatatggccaagtgaattctgtgcaaaataatccaatggggaaaagacagtctttgcaacaaatgatgttggaaaacctgaacatttatatgcagttaaaacaacctgacctggagtttgagaccagcctggccaacatggtgaaatcccgtctctactaagaaaaattagctgggcatagtggcacatgactgtaatcccagctactcaggaggctgaggcagaaggatcatttgaacctgggaggcagaagttgtggtgagcctagatcacgccactgcactccagcctaggcaacagagcaagactccatctcaaaaaacaaacaaaaaacacaaacaaaacaacaacaacaacaacctgacctaaacctcactttatccaaaatttaactcaaaaaacattatgatgtaaatatgaaatgaaaagccatggaactttttgaaaaaatcagccaggggtggtggctcatgtctgtaatcctagcactttggcaggccaatgtgtgaggactgcttgagcccagaagttcaagaccagcctgggtaacatagtgaaaacccatctctacaaattttttaaaaattagctgggtgtggtggcatgcactggtagtcccagctacttgggaggctgaggtgggaggatctcttgagcccaagacgtcgtgtctggaatgagctttgattgtaccaccccactccagcctaggcatcaaattgagaccctgtctcaaaaaatggaaaaaacaaaacaaaacaaaaaaacctttacaacttggtgttagtctaagagttcttagagataatagcaaaagcacaatcaataatttaaaaacagatcagttagattttgtcaaaatgtaaaacttttgctttacaaaagacactattaggaaaatgaaaagctaaacttcaaaattggagaaaatattttcaaaccacatgtctaacacagaacttgtatccagaatatataaagcactctcgaaactcaataaaaagaaaacaaacaactcaatttaaaaattcatgataatatcaaaaggctggtgagaatgtgcagtgactagaacactcctacattgctgttgggcactctcttgtttacacttcccatatgcctcagcaatactattcctgggaatttactttagaaaaataaaatttatgttcacagaaagatatgtacatgaatataaacacagctccattcataattgctgaaaaacgaaaacaagccaaagttctagcaatcaaagcctgacacatttgactggttaaaaaaaaaagtttatgttatatttagacagtttattacttagcaaaataaaatgagcaaaaatgccagatacccaagccccttatctcaaaggatgacactgaaacaaaaatagcgagtaatgtgatgatgtatcatcagtagtgggagcaacctgctgctgcagatccaattgcatcttgcagataagcagctttatactttgcagttgtgcccaaataacagagaggcagagagcctcaggcctcttcaaaacccatgaagtgatgagtaactgtctcatggcagcctccttggaagataggtagagggggtaggctcttcaaagcctcccacactctcatgttccaggaatatctcagagcattttaccaaaacttagatcagctgtagttaagccttggccaaatagcctctctagagacatgcagggaagatgtttatcataagcccagaaacccctctcctgggattagagagaccttagggagtgaaaaatgttgatcacacaaaacaattgtatgtcaatgtttgtaatagctctattataatcacacaaactgtaaacaatccaaatgtctttcaacaggtgtatgaacaaattttggtacattcatatcatggcatactactcagctctaaaaaggaaagaattattgatatactcaacgccataaatgaaatcactgtgttgtaaattctagatttgtatttcatttaatataatttcttcacttttaaaaagtgttaaacttatattttcttttgactattgaggtaaaatatacgtaacacaaaatttatcatgcaagtcatttggatgtgtacaattcagtggtattaagtgcattcacattgtttcacaaccatcatttctattcctcttcagaactttttcatcatcctaaactaaaactctgtacccattaagcaacaactttccattctcccctccccagatcctggtgaccactattctattttctgcctctacggatttaactattctaggtgtgtcttattagtagaatcagacaatatttgtccttttgtgtctggcttatttcacttagcataatgtcttcaatgtttattcatgttgaagcaatcagaattttattctttttaaaagctgaataatagaccattgtatgataagccatattttgtttaaccattcatcccgtgaagagcatttgggcggtgataatcttttggatattgtacataatgctgctgtgaacattggtgtgcaaatatctttttgtgtcctggctttcaattattttgctcacacagttggcccttgaacaacatgggtctgaactgcatgagtccacttatatgcagatattttcaataaaacttacactgaccattcctgtccctcctgcctccccttccacttcctcatcttctcccagagacagcaagaccagctcctcatctttgtcctcctccttagcctactcaacctgaagacaacaaagatgaagacttttgatagtccatttccatttaatgaatagtacatatatgttctttcttattattttaataacattttcttttctctagctttctttaagaacacagtatataatacatacaacatacaaaatctgtgttaaatggctgctatgagtaaagattccagtcaacagtgagtatgtgtagctaagttttgagggagttgaaagttaaatgcagattttcgactgcacacgggtcagcaatcctaacccctgaattattcaatgatcaatcatatacctagaagtaagatttctgatcagatagtaatctatgatgctttttacagtggctgtactatttttcattcccactggcaatacccaagggtttcagtttctcgacatcctcaccagtactttattttcttttctttaaaaacaaaataacagccatgcatcacttaatggtgggaatacattctgagaaatatgttgttaggtgattttgtcattgtgcaaacatcatagtgtgtacttacacaaacctggatggtatagcctgttgcttctaggctaaaacctgcatagcatgttgctgtactaaatactggaggcaactgtaacacagggtaagtgtttatgcatttaaacatatgaaaacatagaaaaggtacagtaaaaataaagttttataatcttatgggatcattgtcatatatatgttccatcattgacttaaacactatcatgtaatgaatgactgcatttagtaattatttatttatttttttaatttcttatattgttattgaaacaaaattttggttctttattttaaatggaactcactttttgttatgatgtaaatgacagatctaacatttttttcttccaaaatagacagccaattgccaaaacaaatatattatttttctagaattatccaaaatgctacctaaaattcctattccaaatggatctgattatacgttctgtactgttttccatagatctatttgattatttttgtgtcagtactatactgttttaatcatgatggcttttatgcttagtttaatagctggtacagcaagccttcactcacactcttctgtccaattgttttaaacagtttaatttaatgctgccctcaggctgagaaacttgtgccagaatgtaaattaagtacagcacttactataccatctactttacctgatagcaagacttttttcacaaattaactggtgcattgacctatattctgacacattctgataatgaactagttaaaaaataaaacagttcatgtaagttgcgatgggtggactgcacttgagttatattggtttagacttcttggctatgggtaatctaaagccagggaaccatgcttgttctagaaggttttttccccctgccctcctacccctcctaactttctatagcatgcacatccctgcaagtccctttcttgcattttctctctagtgtttctgatgacttttctcttcccatgctgcagcccatagagcgactgagcattaggactttctgaagggcttaggcagcatggaatcccataaaatctctggtatcatctctcacttaccaactagttaaaatttcatcttcttcctgagtggtgcaaaaactattctgaaatcaaattatgcattctttcttgctttattacttatagtttaaactctggctccttggaactcacaaatcttttttttctctcaagaaagttcactttttataataaaggcttgttttagactactgttgtggttattggcttaaaacattattcttgtagattttttaattcctgaagtttttctcagtcttttaggaaaaaagaaaaaacacaaaaatgtgttcaatgttagagtctgcttcgatctctacttatggttgaagtaatgaagacagagaagttgtagcatgggaaaataattatagtctggtaaaaactggtcattagaggagcctggagttgagggaaggaacaagagaatacaagtacaaagtagacatgcttgcaggatgtgcgcatttccccaggaatcactggaaacatttttggagggtatctgataaagactgagcattgtgtactcataatagatgagttatggatagtcagaccatgctagatgagcccgaaagggaagggtgactcctcagggtaaagaagttacagatatttgaattgcatgggcagtagaaacttacatgcagcatattattttaaaacagttcatttattcatagctattataaattgcataataaaaagaagtaaaaagtgaattggaagtatgtttctgagtgattaggtaatatatttcctacgaaattaacaactgatgagtagaagaggactcaagtagtttcggatccatccctgcttcttgggtagtgcgtcaataagactcttggcaggacacttcttaagggattattaggtgtcggtgcttataatcagcatcttatataataaggagatatcattatttcacatgtagagcttcagtttgcactcacgttatatatatatgtatatatatatatatatatcaagtggaatatattagtaatatttcaaaagtactgcaaatatttcctcatttcaaagagtgctcttctcttccttctactgctgaagtaatatccttgtatatctccaattttttttttttttttgagatggagtctccttctgtcacccaggctggagtacagtggtgtgatcttggctcactgcaacctccgcctcccaggttcaagcaattctcctgcctcagcctcctgagtagctgggattacaggtgcgtgccaccacacccggctaattttctatatttttggtagagacaggtttcatcatgttggccaggctggtctcaaactcctaccttgtgatccacccacctcgtccccccaaagtgccaggattacaggcatgagccaccacgcccagccatgtgtctccaattattaattctagaaaaagataaaggcttattttatataaattccctccatatagataacctttttatccctcagaaaatgtacttataaaggagcagaaatggggcaaaatggtttcacatgctacttattgacaggaaaagacttaaagttggggtggaaaagaggattcaatatcatgttacacaattcttcataagatttagtttgctttttcttggaagcacagattaatttggagtcttttacctttacatatggatttcaataacctttttttattcttagtgtataaaattgcctgccatttccctcccacaagtaatatcattataattttaatctaattagtttgcctacatacttgcattccttcatcttcttcctattccatttattaatatcattctttcctctctttattacctattttgtcataggaatatagttcaatatcaagtcagcatttacctgacaatgatactaaaaataataatacaacatttcttgaggacttattagctcccagtgtatatgttaagcatcttacaatcttacacaaattatttcatttcattgtcaaaacaactttataatatagatactaatagtatatttcatttatgaggaaactgatatttaatgatggagtagtatcatcaaggtatcacataacttgaaatggaagaatcaggatatgaactgtctcagttcacagtatcattataaatttaagtgatattttttaacttaaaagtaacatttatctcctataaacctttttattttctgaagtgtttttaaggatagttttctaaaattaaagttcaaaatgaaataattcatttacattcttggaggaggaatgaacgataggcagtttattaaattgatatttcctatcaaaattcttttagcttccatgttcatcttcttttctgcattgctattacttctaaatgatatagtcgaaatgatattctttcaaatttgaccgagtttagctatttatccactgaaaaatctcttgttgaaatttgatgtccaatgttggaggttgggccttgtgggaggtgttgagtcatgggggcagaaccttcatgaatggcctggtgcccttctcaaagtaaagactgagctcttgctctattagttcctttgagaacggattgttaaaaagaggctggcatctctctccctttctgaaaccatgtgatgcctgctccccttcaccttcctccacaagtgggggcagcctgaggccctcaccaaatgcagatatcagtgccatgcttcttgtacagcctgcagaattatcagctaattaaacctctttctttatcaattacacgctctcacatattcctttatagcaatgccaacagactaaaacaaaattgagaaacttcccaaatagatcactctgggctaagttgtcagtagaataacatgcagaaaactttaccagtaaaactgcatagaaattaccagaaaaacaataatatatgaaaaatcatttccatgactaaagtaagctacaaaagttatgagactcatgtataccctctattctggaaagaaatgaaataatcccctatactgatagggcagatcaggagaatcagccattccctcccttgctgcagcctcgtcaaaaataggtctaatgtaggctttgggagagcttaaagtcagaacagagaacgatgctctggcaaaagaggcaaaccatgtggtctgaacagagggagcagtcactttccaattttttttttttttttacaaataagcgtaagaaagaaacaagtttcaaagacagtagggaagaggaatggatatttaatagcttggtctcaggaccactcaggttccatctacaaattgtattgttggcatttgattaaaacttacttattactttttaaattaaatgactttattaatatgtctattttagatactcccaagagttacgggaaagggaaagtatgttcgttaggcaaaattccatgaaataaatccctagggaactttaaactttgtttcagttttttccaatgaacatgtattattttacaatggaaaatttcaactaaaattatttccagtaagatcataataagtctaaatttttcaactaaagaatctaaatgtagttgttattcagcaactactcttcctcctgctaggtttaatgctactggatcaactcaatcttttccacaatattgtcactcatacttgcttctttctgtgagtctttattcccttgacatagttgctatttcctcctccacagggagcaactgtatctcaggcagttacaaaatcaaaaattttctgtcaaacagcaaaatagggttgggcacggaggctcacacctataatcgcagcactttgtgaggtagagatgggtggatcactagaggtcaggagttcgagaccagcctggccaacatggtgaaaccccatctctactaaaaatacaaaaattagctgggtgtggtggtgcgtgcctgtaattccagctacttggaaggctgaagtataagaatcacttgaacctaggagacagaggttgcagttagctgagatcatgccactgcacttcagcctgtgtgacggagtgagactgtctcaaaaaataaaaaaaaaaacaaaaacacctcaggaaaataagattattaaactggaattaacaatttgtctcttacaggctaattggaatggagaatttttctgaagttggcggccagcctcattaaaaaaaaataagatctcaacttttaaacataagctctctattcagctagattacaaatatgaacttgtaaagtggtaatgctgattttcttccttagttccatatggtaattagtaatgagagtaaatgaaatagggtgcggacatagacaaatgatagcaaaatttcagaaacaagagactgcctaatgattaaaacagattttaaagctacagctataccacaaataaattgcctgttagaagctaacaaaatgtcccaatagatacattgtaaaacttaaccacacatagaacatagtgtgtgacaactcattttaagatttagtgtaacagtgactgatcaccaaacctaatgagtggtacaccatgaaatatccctcttgggggatcactgtgagtgtccttaaagggaagaaaatctcttctgagacttgtagttggttataaaattttcaaatgtttgaatcagtgttcagacttaggatcacttttgatgtgacaaaatacattaggtctatctttcagaaattacccagcactttgacccatgccataaaatttctatatcacattagaaagtcccattaggatacattgcagtgagaatctggttaagacctgcactgaagcgtgtttttcaatcttactgtacatgagggcaaatttttacttccttgcctctgcaatgctgaggcaagttaatttttacagccaaatctcatgtcactggtctactggttgagaatcagactcaggaagcacatcctgtgcattctggactgacctgctacaagaccctggtgacttgccatctcctgatgggaaaggaaacatcagatggatactcagaacatcactgggcattagtgtggttcctaaccagaattttgttcaatctgcacatggtccaagagattatctgatagggatcccacagaattgtgagattttaaaactgaaaggaatattagaaatcatatagtttcacccaaatacattatagatgtgaacaaaatttattgaatggagatagtacaatgagacaacatatctacatgtcctttgtgatggttaattttatgccacagtactcagatatttggctaaacatgtctggatgttgctgtgaatttatttttaaattgaggttagtttttaaatcagtacacttgagtaaaacagataaccctccatgatgtgaatgagcctcatccaataaattgaaggctctagaaaaatgactgacatccccaaggaagagaaattttggccaaaagcctgccttcacactggagctgcaacatcaactcttccctgggtcttaggctaccagcctaccctgcatattctgggcttgccagtctccgaaattgtacaagtcaatcccttaaaataaatttttctctctccacccacctacacccacacacacacatacacgcacccacctatacacacacacacacacacacacacacacacacacaatctattggttctgtttccccggagaactccgaccaatatactttcatccctgcaaggacctctcatcacagtaagtcattgaaaatccataacgtgacctataaattcctcatgatctgactgctggagacccctctgacttagtttactaccatttcccccctcactcattgtgtccagcaacactgaccttctgggtcagtttctatgttgagcttttgcatgtaaccctctcctgtggaatttccttccccagcaagagcacactctttcatttcactgaggtctctgttcaactctcactctaaatcctcacaacacaagtgggatttatgagctagtagcattgacatggcccaggagcttattaaaaataaagaatttatcacagatcttatcctagacctactgaatcaaaatctacatattagtaatatgccaggtgattcatgtgcatgtcaatgcttgaaaagaatagatgtaaagtgtcacctcccattgctctttggctctttgcctgcttcttcttcatggcattcattactaattgacattatattattttttatttacctgttgattgactgtttctctcactgtaaatcctaaatggcagggattctaatctcaagactggaatctgacctagcacacagtaggcatgcaatagatatttttactaactgaagaaataaatgtcaggcttggcagaatcttctttctcattgtgttttatgtctatagcattctttatcaactctatgttcctttaactcctacttagaatttaggtctcagtcaaggcagtgcttcttttgggaaagtcttttttgatccctccggtggtgactgggccctttggtgtgcattcatgcactgactcatcacagcacttaaaacacaagagagtaggtcctccatgaagaattaatgagtgaattcatgctggtcataacaaataattcttgactgaccactcaacatcctctacttgctcctttctatgcaatgactgatttttgtgcagatatctaatatcctccaatatgctgtgctacaaaccatatctcttacccactcccagggagtatgatctgacttgcccaagacaaaaaatggcagtccccttttccttgccagtgactggtttaagaacgggcaagtgctacagttctcattaaggagagaggagaccatgcccaggttcttagggagaggcacaaaataaggcaactcttttctccctctgaaaacttttgttgtgtatgtgtgatatcagattactataaccatcatgctaatagctattaagatgaagccaacccgcataaaagggtttagaaaaaacaatagcagagaagtgaaatcagaacttagattgtcctgctcttggactttgtatcatagcgtatggtaagtgaaattagcattgagttatttgaacctggaagcatcattttactttggtgatatgagtgtaaacttaaaaactacctccatagtggttgaaaagcaaaagtaattattagtctctgttaatgtacatattttcttttttttccccaactagaaaatttaatagtagtaggaggatcttcttagcgtaatagtaagtaacagacccttaaatttataaaacttatttgttactagacattaatcaacaagcatttactaaacgtataactattatactataatagagaaaatagcgattttaattttgaagcaaatcaagaaattcttatttgttgttggctgtccgaaggagcatgtttaggtcacttagttaaattctttaaacagtgatagaatcagtaaagatgttgaaatatccaaaatctatgatctccgaactcccaaaagaaaaaggaattaattgcgatgtatttcaaaaagtaagtgtacagagagattacaccaatttgttatctgactaaattgttgcaggactctgtgtaggaacagtacatacaacaaggcatcttttaaaggacagagtatttcctgaactacatattaatgttatttagacagattttttaaaagtttgatatgtacatcaatataaaatttaaaagggagtcatgggtgggggaaatgggaaaatgctggtcaaggtgtacaaagtttcatttaggtagcataaagaagttctggagatctaatgtgcagcatggtggctataattaatgatattgtattgtatctttcaaatttgctaagagagaaatcataacttctcagcacacacatgaaaataataactatgtgaagtaatgtatatgtttattagcttgattgtagtaagtattttacaatgtatacgtatatcaaacatcatgttatatactgtaaatataaaaaatatttgccaattataccttaataaagctgaaaaataaataataagaagcacttataacgccacagtccagagataatcacagtcgaattttctggtattttttcaatagttttatatgcatattttatgactttaagtataaatctaccacaatttaatcttcccatattttttgatatatattttgtttgactattataaatagtactgtaatgaatatgctttgcataaaactttaaaaaataaataaaacagtaaaaaagaaatataaatgaaaggagagtcaataaaaacctggatccaatgcacaaatgcatggtggcatctattaattcatttaatatttattaaatagtttgtgccaggtattgtacttgacacagggagtacaatggtgaacaaaactagaaacagtctctgaccttttggggctcacatattcaagaaggaaaacacttaaatagtaacacaaacatatgtttgaaagtatgaaaaaacattactggaagctgtcaaggaattttcaatgagtgcagaatatttgaaaagcttgagatataaaagatgaacagaagttgtaaggtgggagaagagatatctgagacaaagggtagagaataagcagaggtcctaaagtaggagcatttttggagtcttgtggaagtaaatgatttttttcgctgtaacccagagaacaagagtggcacaagaaaaatatggaagtatagtaggatattggaccctgaaattgtttgcaaactatgttaaatgtatgttatttatcgttaaaaaatagtgagatatctacttatattaagcagagggtgcaaggggtgcataaagaggtgagactgaagtctgtgcatgagaagttcaaatttgcattttagtataccctgcactacagacactgaaatacagataagcaaaaatggatgtaggtgcaccagttgagggctgttattgtgattaaggtgaaggataatggaagctttaactatgatgatagtaaaaaatgagagaagtgaacagaagagaaagatatctaggaagtagaatcaataaaatctggagatgagtttaaaagcagggtagcactgaatggaggcagatacgagacttaattgaaaacataaaacaggaagagaggaaatgagggtagtatcttttcttctatgaagtttgactataaaataaaaggagaaagacaatgagatagcttacatctaaaggaaattttgtttaagtgagggagacttgtgcatgtttaaaatattttgagaaggatccactttaagtagtaaaacacacatgacatataaaaatataatgaataaagtaagatttttgagaccaaaaatcaggaccagagtaagctggaaacatgggctttggataggaggaacaacaattcctctattggaactggaagaatgcagaatatattataagtgctagattttattgagaatattgctgtttgctgttgtttttaatctgtaaattaagagacaaggccatctgtcaaacatgaaaggggaacgcacgaacaggaagtttgaagactgtggagaaggtttgaaattgtaattgcaaggagtcaacatgatcagaatagacaaaatatctataggatttgtagataagatgaggttcaaatgagattggcaagcattaatttatagcaatgtcaatctgcctgttgtgctttgtctcttgaagctcttggccacctggctctagacatggaaaagtggatagttggaatcatccaagatggaagcatttgaatgaagcattctaaagcagttataaacatggattttggtggaaacctgaggcattcattgtattactcaaggagaatgggtagactaataaagaaaaaggaagaatatattagagttggacaagccagcaaaagagacagataagtaggtagaagtaggaagaaagccaagagagcctattatcatgcagaatgaaggagagaaagcaagaaaggtcactagtcagccgtgtcgatgtgaaagggaggtggaaaccagcactgaacatttagtaattaaaatgtcattaattctcttgaaaagaatagactgcatgaggtaaaaaaatatgtatatctgaaggactaaagtctgagcaagacaatttcaagaaacttgtactggaagaaaaaagtgagagaagcttgccatcaacttaacttttaccagcttaaaatggattgtttgttattcttccatctgaaaatttaaggatccagataaaatggaaggagaaaaaacggtcatcatcaaactgctaataatgataaattctggagaggaaatggcgttggaaatatgcaacatcccccattgtttattgtccatggttctctgttccttgaaaactgtcattgaaaaaagtagcattttttgtaattataaagtcaattaaaaattctagaatgcttctaataatttgacactttatttctagtattatctctatcatatttttataatgtatatctatgtcttacaacatatatcaatgcatatctagtattattatatctttcttatttttacaatgattcataaagaatacagctatagtaggcattccttcaaattgctcaagactgttttgatttctaacttaaatttaagttttcaaaagttcttcagcatattgagatgtttttgtcttctttttagcacagctaaaatattgcaaaatccctttctaagctaattttccattaattttccatgtggatatgagtcttttatgttttgttttattttacatcaacaattttcacgccagtgaattaaatacagctttttatttcactgctgaatgttcttcagttgtctgtaaaactgaatacattaaataatttattataatttaattaacaacatatgcttacctagtgacatcacatataaaggtcggctccaccgtgaaaatgctccaacttaagacatgctcagaagtcattttaaattttggttgtttttattgttgtttgactattcaattctgggtgataaataaaacgctttcccatgctgtccttacactgattatactcaagattgctttctacctaactcaaacaaaaccccccaaaacttacaaatatatattggttgctgaaaatgctcatacactcaatttgaaaatattccaaatcttttatgggttagacttttgtttcttgctcaatttcacactgacgtgtgtaaaagtattataagcatttgctatttagttcattatgggcaaaacagcagattgttttgtattttgaaagcatcctccctgggcttttaactaatctctcaatcacatgagaaaagctaaagaaagaataagatgctagcctatatacacatcatagaagcttgaaattggccaagtaccttggcagaaagaagggtgcttttattctagtgaacagaacaaagtagaatgaatttagatttttttttttaggagagaaaagtgtgatttacacaggaagagccatttcgtccaggtttgttgagatttgggcagtgtgttctacagcaaagacatctcccctgtagactctggaacattctgtattatcctataacagatgatcagccatatggtgaagggggaggaaaatcagggatataagaatctgctgtactagtagatgcatgaatgagaaaacaaaggttaaagccaaatttggggactgtggctggttttctcattttattttagagattttttattgagtagcacttcttggcatatgccaatatatttttaaagttatatttatgtattaagttttcttataaaaatatttttaaagttctctacaataacaaaattgagataaagtctcacaatttgttataatttggatacctctgaattattaaaattaactataaaaactcaaaaagtctagcgtttcagagatgttataaaacattttgaaatacttacatgaaataatctaattattccagtatgcaagttcctgctggtagtaggttagtaagttgttttagaaatctacagtaattctttcaaaacacaaaaatatagtgtggtagtaactcatgtaattttacctcagctgtttaaagtcaaaccaacttcaacactatctcaatatgttatgcaatcattcatatagcctaagagataaaaaaaagttttataaaatgacattggtagaaaagagatctgacacttgcctcccactttgcaaactttctccatgtttttggtatttatttatttaattaacatacaaattgtagatatttatggagtacagtgagctgctttgatacacatatatagtgtaataataaaatgagagtattagcctatccaacactttatacatttatcatttctttgtggtgagaacattttatatgcttaggctttgtgtccccagtcaaatctcatcttgaattctaatccccataatccccacatgtctagggagagacctgatgggaggtaactggatcatgggggcagttctcccatgctgttcttgtgatagtgagtgagttatcatgagatctgatggttttataagaggttcttcctgccttgctcctcatgcttctctctcctgccgacatgtgaagaaggtccttgctgcccctttgccttctgccatgattatagttttctgagacctttcaaccatgtgaaactgtgagtcaattaaacctctttcctttataaattatccagtctcaggtatttctttccttttttattattatactttaagttttaggatacatgtgcacaatgtgcaggtttgttacacatgtatacatgtgccaagttggtgtgctgcacccattaactcgtcatttacattaggcatatctcctaatgctatccctcctgcctccccccactccacaacaggccctggtgtgtgatgttccccttcctgtgtccaagtgttctcattgttcaattcccatctatgagtgagaacatgcggtgtttggttttttgtccttgtgatagtttgctgagaatgatggtttccagcttcatccatgtccctacaaaggacatgaactcatcattttttatggctgtatagtattccatggtgtatatgtgccacattttcttaatccagtctatcattgttggacatttgggttggttccaagtctttgctattgtgaatagtgccacaataaacatacgtgtacatgtgtctttatagcagcatgatttataatcctttgggtatatacccagtaaagggatgttatagcagtgtgagaatggactaatacaactttcaaaatcctctcttctagctattttgaaatgtgcaatacaatatagttaatcatagtcacccgtctgtgcaatagaacagaagttattctgtctatctaactgtaactttgtagccattgacgaacgtctctttattgattccttcccctctacactccctagcctctggcaaacactatgtctatgagatcaacttctttagatttcacatatgagtgagatcatgcagtatttgtctttctgtgactggcttgtttcactttatcttccagattcattcatgattttgcaaatgacaatatttcattttttgaatggctgaatagtatcccactgtgtatgtataacacattttctttacccattcatccactgatggacagttaggttgattctaaatcttggctattgtgaatggtgttgcaataaacatgggagtgcagatatctttaacactgatttcttttcctttggatgtatacccaatagtggaaatgatggatgatcccatagctgtatttctaattttttgagagacttacattctgtttttcataatggctgtactaatttagattctgagtaacagtatgtaagtgttctcctttctctgcatccataccagcagttgtcattttttgtcttttagataataaccattctgaggtgaagtggtatctaattgtagttttgactgaatttccctgatgattagtgatgccgaacattttttcatatacttgttagtgatttgtatatgattgtatatggtgtttcttttgggaaaactctttccagatcctttgctcaatttttaattagattgttttgttttgctttgttttttgctattgagttcagttgagttccttatattttctggatattaaccccttgtcacaagtgcagtttgcagacatttactctcattctgtaggttgtctccttattctcttgactatttccactgctgtagaagagacttggatacccatgtcttctagtttcatgtaacttaagttgttgatttgtttttgttgtctgtgcttttgaattcttgaccaaaccaaagtcataaggcatttggaaaagtacagtctcttcaataaacagcactgggaaaactggatatccacatacagaagaacaaaactaagctcttatcttttaccatatacaaaatcagctcaaaatggattaaagacttaaatttaggaccccaaaaatataaaactactagtagaaaacataggggaaatgctttatgatattggggtcatttattttttctcttgtacatttgtttaagtttcgtatagactctggatattagacctttctcagatggataggttgcaaaaattttttcccattctgtaggttgtctgttgctctgataataatttattttgctgtgcagaagatacttagtttaattatatctcatcaatgaacccattaaaaagtgagcaaaggacatgaacagatacttctcaaaaaaagatgttcatgtggccaaaaaacatatgaagaaaagctcaatatcactgatcattagaaaaatgcaaatctaaactacaatgagatatcgtctcacgccagtcagaatggcaatcattaaaaagtcaagaaacaaaagatgctggcgaggctatggaaagatagtaatgcttttacacagttgatggaaatgtaaattagttgaaacattgtggaagacattgtgacgattcctcagagacctaggacaaaaaacactatttgacccagcaatcccattactgggtatatactcaaagaaatataaatcatcctattataaagacacatgcatgcatatgttcattgcagcactattcacaacagaaaagacatggaatcaacgcaaatgccatcaatgatagactggataaagaaaatgtggtacatatacatcatggaatactatgcagcaatacaaaggaatgagctaacatcctttgctgggacatggatggagctggaagccatcatccttagtaaaccaaggcaggaacagaaaaccgaacaccacttgttctcactcacaagtggaagctgaacaatgagaatacatggacacagggaggggaatgacacatgagtcttatcagcaggaacgggggatgtggggagggagagcatcagaaaaaatagctaatgaatgctgggcttaatatttaggtgatgggttgacaggtgtgacaaaccaccatggcacatgtttacctatgtaccaaaactgcacatcctgcacatttaccctgaaactgaaaataaaattaaaaagtgagagacagaacacaattgacaacagatttcaatagtatattttattacatttttgcaacagcattcttcttggcttttccttcaaaaatgattttccaaattttgtactgagataattaaaaggcaattgagttttttctaaaatagttgattaaaacttgtttccattagtgtttatttttgttatgtatttatcttatttgttaaataatgaaaactatttactttttatttttaatatgtattattttataacatactgcagaaaaatatatttcatcttcattttataattcacaatgttatataaaacctctctaccaagttctgtcataaatgagctgaaaaatatcagaacatttgaagctgtcttctgctatgtctaatcttaagcatccttagaattgattattctctaactagtttgatattaatgactccttagagtggcagatttttctttgtgttatttcattgatatttgtgtttggtgtcaaattagcaagaaatctagatatttttctcatgtcctcctaagtcacattccttgtcactgactatcaaacattcaaaatgtatccattatttatgttaatatttaactctttctccaaataaattcctgctttgatatagtctgatattttattacaattggcttgcagataactttttgttgattttatcattcatctttataaattatatttcataatctatgacattaatgtcagtactctgttatttaaccaataaaagtaaagatgatgaaagataatatatttgatatacatcaatttttatttctacaaattttcctttgtgttatttgaatttagaacatttcaactaaaatggcatttctgggccttatcaatagtttgactaaatttttgaaatcttgtttgtatttgggtttatcttttgaatcttttatataatatttcagagcttttaaaatgttgatgtatctatcatgcaaaaattggacagaaggggttgtttttgacagaatctggcttagaggaagtaaatttgggaatgcattaagtttaggtttagtgagttctacttatgtggttgacagtaatttcaatgaatgatgtagaaatggcttccaggaatatttctacgacccactctgaaaattcactcaaactcatggcaggagagtacagaaacacatatcgtattgtaatatgaatgcattctacaaccccatcaactccagcaaacacaaaggaatgtgttgatggaggggaaggtatagtttatagtcatctttataggtctgcagaagcatttcttgcctggatcttagggcaatacaaactataacttcacacatcaggaggcccttcatatcacaaatactcacataaaatatttgttagataaattatgggcaattctcaaccaggatctacattcacagctgatatagtgcaactcctaactttaaacatccactctcataagtaacatcaacaggccccagggaaatacttctcatatcttgccttaacttctcgaaacaaaaggtagttaattttgaatgccttcaagacttgtgtgagtcagacactgcttctaagttcataaagtgtttgaatagataaagcatttaggtaaaagaagaaacaaattaaccaaatagtcaaatcttcctttcaagtagcaataatgcaatagattcttacataatgcagcattattttccagcaatgctccagcatgcacttttattctttgttctatgttccaatttgttgtttctaggtattcaaaaagttgtgcagtatgcccaagatgcaggctaagaatgatcttacagtattaaataatggacctgaatcttaaatttatgtacatgtgagtgtctattggtagtatgtgtgaagtatatctttacactgacaatgagatggacactaaacatttgaattgcaaacagattttacacttgaaaatatttaatcagatttaataaaatcttcaagaatattaagcatgttcagctttattaagataatttttattgaaaattttgaaatacataattggtatttttaattgaataaataattgaaatattttaaggactatattattttaaacatgtgtaaactaatttcatatgtaaacaaatttcactgtatgaaatttaaatttttgatgaaaaaatatagctaattttttaaaatttggaaaataatcatgcttttaatcctttagatcattattagtaataaagcttaacgctattacaattttatttcaacaatgtaactagtaattttgcaaatataatgtaattaaaataaatttcatgaaatatataattatttagaaatatctatgtcattttattcctcacccaacatccactggcccatctactgtactcccagacatgcagaataatgataatatttagtaattggtattctgcagatttttagttatatataattcatagctgtacacctgtgatttcttgctaaacagaatttttcaattttaaggtagatgaatttaccattttcccccttatagataataattcttatgtctggttaagaaatttttttcctaacccaaggtcataaagatattcaccttttttatttcctaatattatatagattttgtttctttatttagatctttatgtagaattcgtttttgtacagtttttgagatttgcatctagttacattttttaatatttctagaatcatttattgtaaagcctaccctttcccaacatctcataagaaccacctctattatctatcaagtctctacatatacttgtatctatatattggctcttaattctctttcattatctatattcatattgaagtctatatcctcaatttgtatgccagtaccacacttccttaaatactaaatctcatgctggctggtagggcaaatatgttcaaattattgttctacctcaagagatttttggcttttattgactctttgtactttcatataaaatcttagaataagccaatcacttttcacacacaaatcaaaaacatattgtgatattaatttaaaattctttaaatcaatacacaaatttttggaaatgtgacatctttacaatattaaatattataatcatataacatggtctattagcccatttattttttaaatgtctctaccagcaccccttagtcacaaataattatattttctttcaaaagtgtattaaaattgtgaatcataagtactttgaaattaaataaaattcaacacatatgttgatctcatactatattgtaagtgttgtggtaagacaagagtacggaaccaaggaaaggcatgcttattatgacagtgttttttaggtgtgtttttaactgcatcatttttgagtattgtttattctttttcgaaatactttagctgaatttgttatctggtttgtgttttatgtgccctacaagatacttatatcaatcgaacatctttctgcacattctcatcaagagatcaacagaaagacttcaccacaagataattaaaaataccaaagcattcacacacacacacacacacacacacacaccccagaactttcaactcagcccagattatgcaaattattaagtaaagctaatgaactgaaatctaatatcaatctggaaatgacaggctaaaactgaagctgatttagaaaacaatcccaaatggaaaatagatctgtttcaagacagttttcatttccaaagctatttactccttgtttgagtaaataaactagagaaattcaatttcttctctatttctatagctcatttagctatatatctcacagttgtagtcattttcaaactataattctggaggtggcaagatagaacagtatgttcctaactatgacttacttatttaaatttaagatttatacttttcttggaaattatgaaaagaagtaaaattatttatttgctaacttgatgttcccagctcctctaatcaatcatgtatttctgtgtcagtgtatttctttcagtacttttcatttgctcttttaattattcattcacttatttaactagtcatttattctttcgacaaataggcactggatatatgtcattataaaacagaaacttagcctctgtgatcagagactttacaatgactccaatgatattacataattttcagatgttggcaaaataatttatttatttatttttttttttgagacaaagtctcgctctgtcacccagtctggagtgcagtggcgcaatctcggctcactgcaacctccgtctcacaggttcagctgattgtcctgcctcagcctcctgagtagctgggactacaggtgcgtgccaccatgcccggttaattttttgtattttttagtagagatggggtttcactgttagccacaatggtctcgatctcctgacctcgtgatccactcaccttagcctcccaaagtgctgggattacaggcgtgagccaccatgcctggcctaatttaaatattttctaagtatacttaagtattattgcagaggcatgtcataacctttgaatttcatactaattcatgaatgaaaactgacttctaacaaattcatagattaaaaactattctcaaagcatacacagtgagtaaataaaggagaacaccaaaattagaagagaacatagaaaaaattccatgcagttcacaaagtttatatgtataaattggtaggcgtaaaggtatatgtctgtatatatgagtatatgtgtgtttgtgagagagcaattttcactacaaattcagggttactgtattaaaaattcatagcactgagagggtatttaaaaataaaatacactttacagttttttaatgcaagtttcccattaatttgatttgctgtagattatttaaaaatcagatattattgacaaaactaaaaataaatgaacaaattcattattcatccattcattcaacaaatacttactaattattataagtatatgctgttttaggtattgggtatacagaaacaaagcaaaaaccttattcccttgtttcttttttttttttttttttttttttttttgagacggagtctcgctctgtcgcccaggctggactgcagtggcacgatctcggctcactgcaagctccgcctcccgggttcacgccattctcctgcctcagcctcccgagtagctgggactacaggcgcctgccaccacgcccggctaattttttgtatttttagtagagacggggtttcaccgtgttagccaggatggtctcgatctcctgacctcgtgatccacccgcctcggcctcccaaagtgctgggattacaggcgtgagccaccgcgttgtttcttgcattaaaatatcaaacactaaaaataataagtaatagttgttatataatcacgacatggtaggaacgacatgtgttggtccacgttggtccattttgattttatctttaaacagcacagcaacacaggtatttgtatacccatgttagaaagatatgaggatgatagtttttacatgcttgaaagaaaaaaaaagagagacatgagaaaataaatatcaatagggatgttatttttcatccaaattaggtctaaatttatgtgtatgtttttgtatgtattgggggaggaagatatattctagctgaaagtaagatttttgttaatagtttgaaagaacttcaaaatgctaacaatttttaacatctaagactggaacttaattttatgtctaacgcagactgtccctttgtgctggaaaaccaacacagttgagcatatcatattgaaaacaagtattcattgtttttggagaaaaaccaaaaacaatgtaacacgaaattctgactgaaaacttaactgttttgttttctaaatgtaaattgagtatgactatctttaactaccagtacctctaataactaaggcttactgagtgtagggcattttactgaggctttaaataaaatgcctcatttaatcatgacactatccctccacagtttttacagacattggatagatgaagaaaccaaagcttaggggaatttcagtttatcattggccgcactgcttttaagtaggagatttctgagctgatgcgttaaaccaatatattataataataatattcttaagataatatttcctttgtacaaagtatgcactaacaattcagtttacctgtatacgattgcttttttttaagtaaatatatatgtgtgttcttgtctgaacatttttcacaggaaaatggacatcacagtagtcaaaaacttcagcaaatgtacaggcctagtttgttttgttttgttttgtttttcagtcaactgaagaagaaattgtaaataaattagtaggatttggtataaaaacacagctcagttgggattgttgatgatatttaaacacagacaaaaaagcttttgcaccactttcctttgtgcaatgtgggaattaaggaggagggcctggtccaggggttgtttcatcctaaactgatggaaatcccaggaaagctaagcccaatggaatagcactctcatgatgaccagcatccagtgtggagcacaggagaggttggagataaagaaggacgttttcctaagccaatgagacagcactgtcagaaacagtctgcagtagctgggggaagacttggaggctaactatatttttcaacagacttgatggttattctaatagttaagaggacagattctgaatttgcacagcttgaatgcaaagtcttccctacttattattgtatatccttgggcaaattaattaatattttggagaagcagtttcttcaactcaagattgtggaaaacaagaatgtttatttgtactcctgagagaattaaatatcctgattttgataaagtaattagcatcgcacccaacacagatgaagtggccaagaaaacttggctttttttttatcattattatagatgtacatgtatgatttgtggccatgagctgcagcttggcattacatagaattgagggcaaaataaaaatattcatcctctggcgatcttcatttaactaagttttacttattaaaaaattatcaactacaatctcaaaaataggttcccttacattttagtctggctgataaaagagtaaaattttaaaaagggtctttatttgttgtctttacctcctacacctctattcagctttgagagatagagatgtaatgtacatgatattggagacatggacactggtttattggaggaactctgcagttcacggaattcttgcatatgttatagatcaggaatatgttaatttgtccctgaaattactctaacaccaatggcaattctcatccccactcacccttagaaatcgttaagactaagccagatggggctaatgaacactagtttccattgccaagaattagattaacttaaaagaagagaaaaaaacttaaaaaaataagatctatctgaaaaagtcactatgatattaaagactactctaatttcctcgtcatactgtactacaatactttttccccactttagtttattaaatgatgaaaaaggtaaaaaatgagaactacctctccaaggaagtaatattactctattttccttgtggttgctataagtatattagcacccttggagaccaagttaagcaaaataaaataaacaaataaacaaaaaccatgttgctaatgcaaccaaagctcctggaacttataaaagaatctgtgtccaaaattttgtgttcttatacttggaaaggaaaagcatgaagtatcattttaaaatatttcagtttatttttcttcttcaagaagcaaactacactgctagacattttttttcaaaatgttcaaacaattaaaactgttccaaattttctttgaggaagtaatttcagtttaaagttttaaaaatagccaaagaggataagtgaatgcattggtttacaaaatttcattttttattttatatatttgaaacttgtatattttaggatataaaaaagagaaaaagagaaagaataaaggagtgtctgaaaacatgcatggacatagtgtagtcccttctgagaagcaatatgataatgtgaaaagtataaaacagagaaagatatgcaatcagaaaacatgggattggttcaagaataacccttactgggaatcagaaaaactatataaataaaacctgagtgatagtgactacaacatgatgaactgcaactcctttaaatcagtaaccgaaaacctcccaaaaaagaaaagctaaggaccaaactcgttttacaaggctagcattacccacataacaaagtcagaaaagggcactgcaagaaaaaaacatatataggccaatattcctgataaatatacatataaaaatcctcaacaaaatactagtaaactgatttcaaaagctaattgaagggatcatgtgctatgataaagtggggtttatccctgggatgcagatgcaaggatgattcaacctatgtcaatgaatgaatgtgctacaccacattaacagaatggaaaacaaaaactatatggttatatcaataaatacagaaaatcattgacaaaattcaacatcttttcatgataaaaatactcagcaaattatgtataggaggaatgtaccacaacataatataggccatataaaagaagcccacaaaccccataatcaatgaggacaagctgaaagcttctcttctatgatcaggaataagaaaagtgtgcatacttttgccaattctattaaacatagtactggaagttgtatttaaggcaatcaggcaagaaattgtttttaaacaaaaggtatccaatttataaaggaagaagttaaaatatcactgtttatagataacacgattttatatatggtaagacctaaatttttcacacttgaaaacaacctgttagaaataaaaaacaaattcagtaaagttacaggatacaaaatcaatatacaaaaattagttgtgtttctctacgctaacagggaactatccaaaagataaattaagaaaacaatgtcatttcaacagcatcctaaagaggaacatacttagaaatatatttaaccaggaaggtgaaagatctgtttactaaaaattataaaacattgatgaaataaattgaaaaagacacaaataaatggaaatatgtaccatgtacatgaattggaagaattaatattattaaaatatccatactactcaaaataatctatagattccatgcaatttctatacaaattccaatggtatttttcacagaaatagaaaaagcaatcctaaaattgacacggatccacaaaagaccatgaatagccaaaggaatcctgagtaaaataacaaacctagaggcatcacactatctgacttcaagatatactacaaagccatagtaaccaaaacagcatggttggcataaaaacacatggaacagaagagacagcccaggaataaacccatgcatttacagtcaattgactttcaacaaaggtgtcaagaacacacaatggggaaagaacagtctctctaacaaatggcactgataaaactgcagaagaatacaattaggcccttctctcacaccatatacaaaaatcaactttgaatggattaaagacttaaagttaggatctgaaactttaaaactaacacaggagaaagctctatggtgttagcttaggcagtaatttttcagatataaccccaaaagtataggcagcaaaagcgaaaatataaaaatgggattacatcaaactgaaaatcatttgtacagcaaggaaacaacagagtgaagagacaactgtggaatgaaagaaaatattttcatatcatacatctgttaaggagcagatatccaaattacataatgaactcactgaactcaatagcaaaatacaaataagacaatttttaaaatgtacaaaaaaatgaatgggcatttctcaaaagaagacaaatggctaacagatatatgacagaatgctcaacatcactaattaaggaaaggcagatcaaagccacgataagatattaccttacacctattaggatggctgttaccaaaaagacaagagataagaagtatgggcaaggccatggaaaaacgggaagctttgtacactgttcgtgggaacgtaaagtgctacagccattatggaaaacagtatagaagtcaaaaaaactaaaaatagaactaatatatgatcccacaatcccacttctgggtatatagccaaaggaattaaaatcagtattttaaagagaaatctgaactcccatgctcattgcagtgttactcgcagaagccaagatatggatacaaccactcatcaacagacgcatggatgaacaaatacacacacacacacacacacacacacacaaaatgaaatatcagtcagtcttaaaaaaagaaaatcctgccatatatgacaacatacacggacccgaaatacattatgctaagtgacataagctaggcacagaagggcaaatcttgtatgatctcacttatacatggaatctaaaaaagtctaattcatagaagcagagagtagaacagcgattgccatgggatgggataaaggaaatgaggtgttgcccaaagggcataaactttctgttataagacgaataagttcagggaatctaatgtacagcatggtgacgatagtaataatactctgttgtttacttgaaatttaataaaagggcagattttttttttttttttttttttttttttttttttttttgagacggaatctcactctttcgcccaggctggagtgcggtggcgcgatctcggctcactgcaagctccgcctcccgggttcacgctgttctcctgcctcagcctcccaagtagctgggactacaggtgcccgccaacacgcccggctaattttttgtatttttagtagtgacggggtttcaccgtattagccaggatggtctcgatctcctgacctcgtgatccgcccgtctcggcttcccaaagtgctgggattacagacgccccaaagtgctgagattacaggcgcggagccactgtgcccggcctaaaagggcagattttaagtgtccccactccccagccgcctggcccaaatgctaattacaggtggtaatgaatgtattaattaatttgattgtggtaatcagttcacatctacatgttatcaaatcatcatgctttaaatcctgaatatatacaatttattatttgtcaattaaatatttaaaaacaaaacaaaacaaaaaaccttgcaatctcctgccaacagttaaacaacacaaactattcttcaccagtgtgttcaaatttattttgataacaagagactaaagtaaacgttaaatttacttaagaaatacctgaaaagagattttggtaaatactctttaaaaagcttggtggctgtctcaaaatccatctggaaaatcttcagaaacattttaccaggaattagcaaggtaagtgccgtaaaccaacctcatccaacagaagtatttgtgtatatgggtagaaaatcactgccatcagcagtcagtctgtgctcatcctcccatagctctgacacaaaattatactttaaaaagtttcccttcgaattctgccacccctccacatacttattaatatttattagcaagcaagcaaaagtcacttatacaatctttctataaattgacaaattcacagatctctgtcttttgatgcaattagaccataccttgtatgataaatcacttgaaataactatagcaatattccaaataaatgatttcattacctttatagttagcgataagaacctagaaatctccctcatgcatggacatagatgagttagagataaagcctaggcaaggctatctttgcgatagtctaactaatctatataccttgaattccacttattttaccagtgagagcccacttctaaaatccattatactaattaacaggccactaatttcaccaatgaaaacccacttctttcattttgctaattgtaaatgcctttggtgttgatcaaagataatgataatggaatggctattagtagttcctatggagtgagcatttcctgattagaatgccagtgtgaattcctgattaaccaaatgattgtccctacagtgcagcataaaccatttatacttaaatatcactgtctttaagttgaagtttttcaaattaagttataggcatcataataataaaaatattttaaacagctgtctaatagattatatatgagtaactggcacatgggaagaggtcatatgaaacatcataggagctagagatttttttttaattgatcatgcctctccaaaaaagcctagagcaaggtaggggaaagataaaattaagaagacctaaaaaacattttaagaactttacatgcaaggacatatgatctataaaagtagacttttttttttggtgtgtcaaagataaaagggtagatagggaataatggattataaatcattgagaagtaagtgaagttcctattgaaagttgaagaggagagggatttcagtcattgtggtttatccaggaaaaattaatttgatctttggagccgagaagacagacgtagtgaatcaaagactactacatacacagggtgcattgacgaaccaaggttagatcactcatcagaactgactgatatctactcgagagtttgaaaaaatccagaggtcagattatcaaaattttactcagaagctattaacctagctttataaacaatcaatgggacagagtaaaagcagctgtcaattcatctcttgtccataaacagttcatgagagagtttcagttacatttctaaatattccttggataaaaggacgttaggaattgattgaaggacagctaaatagctcaagtattctgtgtgtttttgggttgtaactcatgaaaatagatatcatggaagaagaaaaaataaaggaatggccaactggaagaattacagaaattataaaggggaggaaatttaacgcttaaagaataaaaactagtcactatttcttcctcttgatactccccaacgttatgtacacacacacacttgcgcatgcacacacacacttgtgcatgcacacacacacgtgcacacacacacaaacacacacagagctaaagaagcttcctaaatgaagccttccctctcctttactctttcatgaggctttaggtatacttatctcatgcaagttatgaagaactttgctgtgctgagattcaactagatacttcaggaaggagccagagtctccaaacccactggattctttgttaatgactggcaattacaggatgctggggcaagggattatgaaagtcagacgtagactaccatcacctactggtccaacttgtcccaaaaacttggaaaacttggccaaaaggccttctatttattgaaaaatgcctgcaacactctgggcatagggaatgctggtttccattttttgagtaaacaatgttggcgaaggcatattattgtcagcatagagtaaagccaatttatttcgatagtttctatcgagtgggaattagaaaaacggatgacccctttgtttaacacatttatatggataaacatatctattcaaattctagactaactttggtgcctcattttgtggggtctcttttctgactttggacacagccataacctctgaagcctttaccatttaacttcttaattttatattttctgaattttagctatttaccctactagaatgaattatataatattttttcataatatttttcacatagcaagtatgtcacatttgtttaatacacatcatttcaagtttgtaagacaaaagttgaggagcaatatgacatcaatctttaaaaataaatatgatgaagaagagacaagaacttgttctctcaatttgtaatgcttgaagccttttaacctgaaacagatcatcttccaacatataaaaagaagactatttaaagatagtgtaagcaatgcatgagcttatttttctatgatcttatacaggttaaatctgtaaccctattatcagagaatttatataagttcatgaaccagagataatttattagtgaggcaacaggagatttggggaacatttctacagtatcattagggcagttctcaaatgtgtcagttctctcagatgacatttctctgcccacttgaactcatgtggtagcagggccatgggaaattaaatgcagccaaaatagcaattcctagcagaagcatgtgtgtagttcgcatcttctctttacctggcctctatgcatgaggaagcaagtttcaagatatagtcttcatcagtatgggtctctgcgtgactaatacatgctgacaccccttgctgacctccaatgaacaacgaatatatgatgtagtgagaaataaaccttttcacttttcattttaagctgctgacatgtttcattatttgctaccaatcctttaatccagcttgtcccacatgatacaattctccaaatcttatgttactgatatcttgaaattcctcaaagccctttaggccctcaagtaaatggctgagggtaacagagaagaaatgcaattgaagagctgttccaggaccttagacatctagaaactcaaccatagccgctgcactttaatctattttatatagatatttatgttgctctcaatccatctcctccataaaaaattgtacaccactattgctagggatagatcttttagtctcggcctataatagcatatcatgttttattcattctacacatatttgataaggcctattgcaaacaaagataggttataaggtactgtagaaaatacaagaagaaaaaggtaacatttcttgttctccagaaccatataatccagctgaaacagtttacaaaatttctttcaaaatttctccagatggagtggaagaagcctatgaacttttaacatatttatttattcccaaagaaatgcacagaattaaatgtaatgaccattttatttttaaaattaatattctctgaaaaaaccctacatatttgcccatgagaaattagtactaatttcagatctcctatatgaagtcctttttatttcagaatccttttgcctgctcttttggtaaatagacatccttaaatggattagggaaaaatttgtctttttgtatctgaaggaggcaaaaggaattaaaataggatttcaaaaggtagccaatttcaaaatcaggcaggctaattttgttataaatagagtaattaaaaggattagaaaaagtgcttccctttgttagactgacactcttacaataagatgtgaacacacataagggcaaggaagtgtgtcataagtaccattagtggccatgatatcagtctctttgttttggatatcctttttcttcatccccattttagtcttctgagtagaatctatccatcatttcaaattctctctttttttaatgtttcctaatcaatccaccagggattgttcttattgtccctctgtacatatgaacacttcagtggttccctagttgtttcatgtgttttagcctcctttcctcaaacagaaattgatttgttacaaactcccatttcctacttttctcaatgtttcccacaagaaaatcttgactatacctaacacattgtaatcctctacacaccatccttttttgcataattcccttcatctcttaatctagaaacccagagaagaaaatacacttattataggaggcccaatttctagtgaattcatcatcttctttatgctttttgtttttgttttgagacaatgtctcactctgtcacccaggctacagtgcagtggtgcaatcatagctcactgtaatcttcaactcctgggctcaagcaattctcccacctcagcctcctgagtagctgggactacaggcgcacgccacaaggcccagctaatttttttttttttttttggtagagacagggtcttgctatgttgcccaggtcaccatcttctttgctgttcatgctcataaatgatttaaacttctattgtggaagtctgttgaagttcaacaatgatagcaatcacttatattttccccatttttttgacaacaggaagtggattttcctttcatttctccagcaccattgttattccctgtggttctgcaaaaataactgaaaatagttctacatcaacatcttccagttctctcagaattctggaatgtgatttgtctagcctagaggcttgaagtcatttaaagcagcaggtaattttactataccaccaattgggctttgattcccttaagcatagttattatactccatctagtttaaagatcattctccttgatagagaaggaagaaacaaaataggagttgaatggttctgcatttttttcctgtcatctgatttctcaccatctggcctaaacagttgggtttatcccttccttgttcttctttgacatgaaaggggactttcatgaattgtgttgaaaaaagaattgaaaactactgtgaacataccaaattgaattgaaaagcacagatcatatctagggaaatgtagtgagaatattactaattgctagatcaaatttacaaggaataaggagacaggaatgagacaaggagatgaaatattcatctggaacaattaaaagatcaatggtgatacaattacaaaacaggaaactaatgttctaaccaaagcatgttttcttcttcaattaataataatacagtgtgctgcactatataaaacagctttataatgtcagttgcatttcttttgcaaaaccacaatgcaggacagaccaaagagatggatgatttgcaacaaaggcaatgcactgaaaacaggagcttttaatagctttctaaactcataagagctgtaaaaatcctcttgaacctacatccatctactctcccaaagaatatgctaaaaaggttaagaaagcggtaatttaagtctcccttgtcatttaattctttgggagtctgtttgtgaactttcaaatctacctggcacttttaatttttttgttgttgttggggagaagggttggctaacatttaactacagtattttttttttttttttttttgagaccgagtctcgctctgtcgctcaggctggatggagttcagtggcgtgatctccggtcactacaagctctgcctcccgggttcacgccattctcccgcctcagcctcccaagtagctgggattacaggcgcccaccaccatgcccggctaattttttgtcttcttagtagagacggggtttcaccgtgttagccaggatggtctcgatttcctgacctcgtgatccacccgcctcagcctcccaaagtgctgggattacaggcgtgagccactgcgccggccttttttttttttttttttttttgagactgagtcttgctgtgtcacccaggctggagtgcagtggcgccacctcggctcactgcaacctccgcctcccgggttcaaacgattctcctgcctcagcctctcgagtagctaggactacaggcatgtgccaccatgcccagctaatttttgtatttttagtagaaatggggttttgccatgttggccaggctggtctcgaactcctgacctcaggtgatccacccgcctcgacctcccaaagtgctgggattacaggcgtgagccactgcgctgggccaaactacagtattattaatgcaaaaagtcccttcacggagacctgaagacataatttgttgctcaatagaaatccagcattttaaaaatccagaaaagaaaacttggtccgattaatcagttgaagattaaagtaatgtgtagcagatactgccaggtggtattccagggtattagaccctgttcattccatactttcacagagacagtagaaaacatagtaaaatttccaatatcataaatttcccttgtagaagctatggcttatcattcttttatttctactaaaaatattcacaagattgtgtctaagttttgtgcttgcattagcaaagaagtatgacattgggtaataggccacccacagtaatatcttccaaactcttaagactggtagcagcaaaggagtagaagatagaagagaaattgtctcacctgacacagaaattgttgagagtttggaagtttaggacataggaaatgtaatgactctacagaatggaaaagggatcaagccatttatttttaaataattttgatttagagtcaaccaataccgttgggaggattctatgccacagtcactctgttatgcactttcacaaccactgtctattacatttcaaaaattatcctgtcacttaggaattatcactcccattttacagaagaaggaatcaagggatgttaagcaattttcccaaggccaaatagttggtgagagagcacacacgatagaatgtgatttcccttgccagttgagggactacagctccccctcattgcgtattgaacgcagaaaatgcagaggggaatgggtgaatggtacccacatttcatgttgtatcgccaacccaccaatcagtgccaaatatttgccattgcacaccccatcagcctctagttaaatgtatctatttatcagtatattaacatattcaccacagtagcatggcatatgcataaaccactatgacttagaagaataaaattattctttggctagcccataaactctcagagttctttatacatcccaccgccttagcagccaaactccgggattattttataagaggagagaaaagaaaccaaattttatctgaaaaaaatcagattaataaatgtaaaggaagctgatattaaactttattttaaagatcacatatagccataacgagatataggcttgaacttggtgtaatcaaagaggcattaatttaaaggaactatggctaagggaaaaaaaaattctattgtttatatattttgttagtatctggagatacaaagatcaatgtagtaatcaatgacatagctgtgattccttacagctcacttatcaatatcataacacaaaagtatctacgtaattgggaagtttagctaagctttattgtagaaaaaggaaatacatactggaagtcattttggggtgttgttgttgttgttgttgttgttttgagacagagtttcactcactctttcacccagcctggagtgcagtggtgcagtcttggctcactgtagcctctgtctcccaggttcaagtgattctcctgcctcagcctcctgagtagctgggattacaggcgtgcaccacaacaccaagctaatttttgcatttttagtagagacagggtttcaccatgtgttggccaggctgatcttgaattcctgacctcaagtgatctgcctgccttggcctcccaaagtgctgggattacagctgtaaaccaccactcctggcctggaagtcattttgtttagcttatttatagaaactatttccaccatgcagtaatgacaacaatctaaggaaatgtcctaacaaccatattagcatagagtgatagataaaaagatattatttttattttctatatcattttcacattctccttcagttaactgaacatttagctgagcaatatatgtcatgtgtcatatattgcatgattaaaaccttttactctaaggaaacaggttttagtatcaccatatcgaacatgaaaatcattctaataccaaaatgtcaaccttgattttttaaaattccgtagtataatctgattaataggtgtcataaggaaatgactgaactattgggtacacaaaataatgttctaaaagttgtattttaaaacgatatatctacataaagtgtgacaatataattatttccagtttgattaaatgctataatcactatctcattactagaataatgaagaaaaaatatagaaatattatcacatgatccatacgagaattaaattaagtagacattacataaaccagaagattcttacgcaatttcaaagttgtcacaaataaattcaggtttgaaggacaataaagaagtaatgatgggaaggaaagcttgataattatagcatggttgctatttatttattcagtgtaaaggatcaaagaaggaattgtcttagtattctcctacttcactgaaacaaaacttttagttgacagtgaacacacgacaaaggaaatcaatttaacgacctttattgaagcagtactggatacaaggtattgtgctaggtcgttcagaacaacggtgaataatagctatactagtttgtcagtgcattcataacacagtatcactgattgatgtggcttaaacaacaaaaattcattttctcacatttctggaggctagaagtctgagattaaggtgttgaaagggtttgttttctctgaggtctctctccttgactgacagatggctatcttctccctgtgtcttcacagggtttccctcaatacatgtctgtatcctaattccctcttcttgcaaggacatcagttatattggattgaggctcatcctaatgacctcattttaacttaattacctctttaaagaccctatttacaaatacagtcacattctgagttacagggggttacgatgtcaatatataaatttgggtggagacataattcagcacataataaagcgttcttgccctccaagactttcaacataatagagaagaaaatatataaaaataactatcatagaaggcagaaagtgataaaagttatagtgcacagtcaaaattattaggatggtgcaaaagtagttgcagtttttgtcatcactttgatgacaaaaactgcaattaaatttgcatcaacctatataaaacatagaaaatgactggataattaagaaaggtttaatggagaaagtagttttctaggatgagatttcagcatattgagataaatataatgaaaaagataggaaacaacaaattaaaagaaaacactgtatagggctaatttttcatttaattataattcatttcaccatattgagataactgtagtggaaaggataggaacaaacatgattagaaaagagcactgtatagggctaatgtttcatttaattataatcaaactgtactctgattgacatggcatattttgtatttaagacaataaagatcatttgactgctgatagaaaagcagaaatagaaaatcatgttttcttcagttttcaatgtaaaatacaccacaggccaataaccagacaaataaaataattctccaccatcttccaacatatcatttgtatttatggacatttttcagaagaaataaaatagggagaaaattagaattgtaccaatcataagccagaagaagacatagataataaaagtccactagcgattggattgtccttttaggaaatctatctatcaaaaatctatgcttatagctctttgttcagagggtcagttcccaaatttatgtgctacaacagtattttaaattctttcctgtaataaaatgtcactgagattttttttaagtagaaatgtgatattttatcaccatggagtacaatgtaagtttagctgcctaactcattattcttagtcctgcttgaaaagtaaatcatatttctgacaatgacaacgaaatctcaattttgattacttctgttttaaaagagcataggataatagtaaggaacctatacaaaataccattttaatatttatagaggggaaaatactgaatttttatggaattataataaatatatacttccttatgacttcttacacgtgggtcactggcagataaacttaatatttacttactacctaaaacatatgacaattcaatggtgctcagccaggttatattaacagtgtggcaaaagtaaaggattttccttttgttcatacaacttatccaatggcacattcaagtttttctcctctactattatggcaataatttaggttcatgtcagcaaatgtttgaaagacatataaatcccacatttcgtatcacttgttagtgtctaattaagcagaaaattttgagttcagtgaattacaaaatgaaatttaaaacacatcagattttacattaggtaataaagatcttggcacgtaaacctttagcactgtgggaaatgagcttcatcttttacattggtgaaaggtgcagagtgatcattctgtgcaattacacagctagaagaagccttgatttggaaacagtgctataccaaggagaaaatcacgttgcatagttgtgcttaatttttgcagtctaactagaatagttatgctacatacatacatctggctttgctctaaagcctatgttgggcatctctgaaacataaacagagtaaattttgcccttgatcactttggacgttactcctgtaaaaatcatatacaagtttatttgagtaaaacagatttaattaaacaaatgtttattaggcatctgcggtataccatatattgtgtaaagcactgcaatgaagtaaaacctaaccatctgtacaaatccacagttgtcggttcttctctttctttgacttcattttttactaatctgatgttttgcttgtttccccctacccattcccacatgtaaattttcttctagaatcctactaacttctggtgggagaggaaagagcctcatttgccaccaaaaccatatataatctaggtcaaaaggatttttatattgccttattaaatcatgcaaaattatccagctgtgtttgcatggacagccaaagaggaagggacttcagcttttgttcattatttgatttaacagctgaataagtaacaaataaaaaactaggcttaacagtcaggtaaatatttttcctgatttagaaaggttccagatggaaaaacttagaattatgatctaaacatggcatccatattttgacattaaaaaagatacagaaattaatttgagaggaaaaacaatttttttttgacacagggtctccctatgtagctcaggctaaccttgaactcctgggacgacagggaaaatcaattttaatagagaacaataggctgaccagactagaggatatataaaactaatatcattgttatttattgtcttagagaatttgagcaattaaggaattctctgtgacagttaatattatgtgtgattatactagccaaataccttccaagtggagcaataaatgagaaaatatctatggaactcctagagatcttgggataaatggttccacacattaacagttgcatttccttttttttttttttttaacagagtatcactctgttgcccaggctggagtgcagtggcacgatctccgctcactgcaaaatctgcctcccggcttcaagcaattcacctgcctcagcctccggagtagctgggattacaggtgcccgccaccatgcctggctcatttttgtatttttagtagagatggggtttcaccatgttggccaggcttgtctcaaactcctgacatcatgatccacctgcctcggcctcccaaagtgctaggattacaggcgtgagccactgcacccggccaatagttgcatttcttaagaaaaaaagattttaaaagccacaaacaaaagtaaaaaacaaaactcacacatacactatttattataaatccataaaaaattcagctattcaaaccaaaaaaaattgatactagcaaattataaatttatttagtgaaatagtgatagtataaatatatatcatgctttaataaagtattttaattaatccagtcaccacacatgtttttgctaaatatgacagacagaagataataaaataataattggcttaccaccctagataagttttaattattccatggtagttttacatactttgaatatgatgttagcttaaaattcagtggttgaaaacaccttacagaattttaaataagtagattttctgatctagtttaagaagaaagggtcaagtcacaaggccaaggctgaatatctctaccttcatgaaatttcccatatagttaggtgaagagtatttatatgtaatttaggtatgaaacataaagtacataaatcactatcaagacagtgaatgcatatttgcaagtaaatattaaatcatggcatgggaatttaatgttgccatgtcaaattatttagatacacaaaaaggacgtatttttctttcctcccatgaccattttccacatacagtattacaactgtgcctgaaaactatgtttcacctacaactgaaagtctctgaagttgattaaattataaggttatgggggattgtagggtagttggtctggatgtcagtgaatattttaaaattaatatttataattaagacagattttatgaagtgtcaaatatatcattttttctggtttagaattttaatagttatattctactgttagcatgtggcagttactgccctaatgcgatgaaagcctgaaatctcaaagccactgattccctacaagaaaatctgacagagaaaacaagcatttgcaaaattatttataaatgaatgtaaagtgttaacttatttataaattcctggtaattacacattttacaaacttatgaagaaccagattgaaatttgattattatacatctgtaattactatagagatgaatgaaatctatcacagtgaacatggattatgttttgcatcttatttggattgtcatgtaagtctttataatgagctactaattgccaatatatgaaatagtgatcacaaattcaaataacaatgaagaatgatgaggtttcaaagactggatgtcacagaattactttgttgatagaaagatagccttggtgtctttcccaacagaacctattttaacacactgtaattatcaggtgagggcttgtttcccccattagactatagatctcttgtgaataagtccagtaggctttatccaccatttcatctctagagtgaatagtaattgctcaataagtatttgttgactgacacaataaatgattaacttgtcaacacgaaagtgttcactgggcacttggcttcaaaggcattcattccccccatactatcaagattgctataaagatggcagaacagaatatcatttaaatcttgttgtcatgcgcctgtgagaaacttttcagctttagctttgagttttcatatactcagagtaagaatattctattgcctgagggagattctgattattttgatgccctaaatctcctaatccaatagatggaaaatgtctgtcatgcagatttgcttatgaaggggcaaaggctttcatcaaaatctttagtactaaaaaagaaaaatagtaaaaacctgagaaaggtaacacaggggacatcaattatacatgtaataacaagtatgagaaaagttaagactcagtaagacttcaccgtaagattacattgtgattctatatgctctaatcttttatggatgcttgaaatatttcagaataaaagtatttttttaatctagctatcctttcctcacactcaccaacaaaactggaatgaaaaatgacataaaacttcagaaagtattattctattagagtctgaccctgggtgataaaggtttaggtatttttcattttcacaaagcattttttaaactgtattactgagattcacagtcaagtgaaagaatataggataatcacaattcttaggtgagtttcaggtactgatatgtgttggtctggcatgatctctctgttccccaggcacagactcatctatgtcacttggctttgcaccctgacatctacttctcctattcaatatgtattttttattataaatgtttaagaaaagtagagatcataaaatatagaaaataatctatctacctcaataataacatgcactttttttcccattggattttgctctaatttttaaaggataaagcattgtagataacactgaagtcctatatgaactcttcctcagtctcgtacctccctctctaaagttaatcactgttatgtatttgatacacatggcatttatgacatcctactgtccataaaacttgctcatccactcaatattactttgaaaatttctctttttaacatatgaaactagctcatttgtcttaactactgtgtttgctgctatttgctcatttccccattgatggaaaaaaaaaactctataatgatcatacttgtaccgggttttccttatgaatatgtgcacaagtttcttcaataaacctagagggggattcctggcaacataacccaggtgccacatattgttattttgttcttcactgagattgtaacaatttacattcccagaagtattgtatgagcatactcttttaagtatatcacatctaataattgaaattatcagattttttttacttttaatatctgatagtcatgcaccctagctcttaagataattcttcagttattttggttaactatatagtctattattgggacaggttgaacaaaagtgctccttaaagagatttatctttctcatactggtttaaattttaacactggcctgccaataatgttagtaataacagttatcttttactaggccactcaatatgtcctagacactattcaaaacatttaaaatatgtaatttattcaattcttccaattgtaaaagaatgtgagctctaaggatgcagagagttttgtctgttctactggttgttctatctttaaaacagtcctatcacctagtaggtgctcaccaaatatttgttaataaatgagtacatgaataaataaattatataattaacattttcaaagaggcatttagggagtctgagtggttatttcccaaagagcatagatttttgtaggaaatgacagaattatctatcttcaagcatacataactccctccaaaaacagatttttttttttaagatggagtcttgctctgtcacccaggctggagtgcagtggtgtgatctcagctcactgtaacctctgcctcccgggttcaagcaattctgctgcctcagcctccctagtagctgggattacaggcacatgccaccatgcctggctaatttttgtgtttttagtagagacggggtttcaccatgttgaccaggctggtcttgaactcctgacattgtgatcctcctgcctcagcctctcaaagtgctaggattacaggagtgagccattgcgcctggcccagatttttctttttctatgttccacgtagtctctaaagagaaaattcactatcttcctgtcaaatctataagaattactttagcggtgaaattttagtaagaacgataggcagtttgtaagaacataattctttttcttttaaaattatttcttttttaattaacaaatattagttgtatatatttgtggtgtacaacatgatgttttgaaatatgtatatattatagaatggctaaatcaagcgaattaacatatacatcacctcacatacttaatcatttttttatagtgagaacatttacttgttctctcagcgattttcaaactgacaatatattgttattaactatagtcagcttgttgtataatagatctcttgaacttattcctcccatttaactgaaattttgtatcctttaaccaacatctccccagtcctctccctttaccagcagtccttggtaaccactattctactccctgcttctatgagttagactttttaggacaatgtaactcctagatgcattttaaaaacacgtagaacttgttcacagcacaggctctggagccattctccaagcaaaggtttttaccggtttgttaaaattccccaggatgctttctaagtccctaagtctattgcaacaacaactcgtaaaatcagatacatgattcctgttttcaaatttcctatctagacccacttggatagcaagattgatgctgttctcaccagcctaaagccccttcagctctagctgaaatctttgttctctcacaatgcccaggaacatgtcttgggctcattggtaggtaggaacgtgctgtgtggcaaggagaaaatttccctgtaatccttcatctaatctataaaatatcctaaaggattcaccatattaacgatttttcctcatccaatttatactgattataggtggttagagttgagatacacccctaaataactgaatacacataaaattgtgagacttcctttgactctctattgctttgttgaaagtctttgtcaatatatctggccattgaaaataatatggtttattaacaatgcacatacactcactgagacaattctaagcaaattgtttataaacagtatattttatcattcacagcctttgtcagtacatagcacatgcatctgaagtatttagaaactattatattgttatgcaagtctaaaatgcaaatccttagggctatttactttatcagtaagattattaatcattactctagctataccttaaagttatagcaaaaattttcaaatctgacttattaagacagtcaaaaaaggactcccagttatggcttttctaaagatctaagtcataatactcaaagaacagtcctgcagtctacttattgtttattcaaatgaaagcaccttaagtgaacttacctgttagtacatgaaatgatgtgtgataaattccagttgacatgcccaaactactcttcagtcatgtaagtacaggcagtaattcaaaacataattaccaataaagcaataatggattactttggggaagcctattcaatcatttctgaatacacactttctctctgtctttcaccatgacctacataaagccatgtgtacatttctcttcagtctccacaatgatccctgaacaatatactgtaacatgaaaatgtaatcacagatgactcaggggaaaaaaatcttacagctatgaaatcactgtctcttaattttagtcaatgttatagaagatcctggctgcaagtcatcactggcctgtcctgacaaggaagagcttcttttctcggtaaatggaaacctaggttattcggcttgagctaggatgcagttatcaaactggttctcaccttcctattgtaacatcttgaatgtgtcagtcatgtgctttcattttttggagatagaatggagaaaacgagggaacacctgttttatattggatttactttcatttctaagggccattaaggattatttagcactacatcacttacttctacaagaagttggcgtctggagatggtgttctaaaaactgataaagtatacaacgttactatttaaaatttcagatggcttactgtcttagcctgtttgtgttgctataaaggaatatccaaaactggataatctataaagaaaagaggtttatttggttcacaattctgcagactgtataagaagcatggcaccagcacctacttctggtgagggcttcaggctgcttccactcatggcagaaggtgatggggagccagcatgtagagattacttggtaagggaggaagcaaagggtgcggggtgccaggctctttcaaataacctgcccttgcaggaataaatagagtgagaattcactcattaccaagaggattgctccaagctgttcatgaaggatccacacccaaggcctaaacacctcccattaggcactgcattcaacactggggatccagtttcaacgtaatatttggaggggttgaatgtccaaaccacagcacttgccttttcctatggaagttcaggaccctatatgaagccatctgttgactttttaagctcagtaccaatcctgatgtagtctgtgcttcttttatactggccaacttgctgtccctcaaacccaccttgaattttcacagtttttccctctttatgggaggcttttccaattttctaaaggttcaattcaataatccagctgaacagctgtttctttaaaaatatttcctcagtatcctgacagtacagcagcattaattgtaaaagattttgtttacgtaacaaatacaattcttttgaaatctgattcatatacaccagattgtgagttctctcaaagcaaattctgtgtatttttcttcattgtattttctttcattccccagcatactgtcttgcacataatagatactcagtttaattttatcaaaatcattttttcaggaaatgattaacaatctccaatttaaaagatatatttgtattgaaccacttcatggcttgatgcttttaatcaaactaaattttgactaggtataggttgaagaataatgtataagtgcaatgtatggtaataggaaattggttataattatattgtataattaatatttgcatagatacatactatattggtcatcttttatcccaactcctattaaataaatatcatattgagatttaatagtgcttagttttgatgcagttaattttaacattttgctcttgctaacattattatgtgttttttggcatcagcttatgaaagaacatggaaaatcaatttattttccattttctttgtcaaatttagattaaaactttgtagaagccaaaggtcatgctcactatgatgtcatggacaaaaaggcctttgttattacattttgttcatttttctctttttttctttcaattttacttgacacataataagtgaaacatatttatggggtaccaagtgacagatacatgtatacagtgtgtgattataaattcagggtaattaaaacattcatcacctcaagtcattatcatttgtttaatgagaactttcaaaatcctctcttctagctttttgaacatatacaataaattattaactatattcaccctacagtgccatagaacactaaaacatattcttcttatctaactggaactttatatgcattgaccaacctccctctatcctccttctcccttactgttcccagcctgtaataaccagagttctactctttacttccatgagctcattgttttgctcctacatgtgagtgagaacatgcaatatttatctttccacgtctgacttattttacttaacataatgtcctccaggctcatccatgttaccaacgacaatatttcattttttaaatagctgaacaatattctgttgtgtatatatatatatattacattttctttatttattcatctgttaatggacatttaggttcattccataccctggctattgagaatagtgctgtaataaacatggcagtacagatatctctttgctatgctgacttcctttcctttggataaatacccagtagtggcactgctaaatcatatggtggctctgtttttagcattttgagaaacctcaatagtattttccataataaatagctgtactaattaacattcccactaacagtacataagaattccccttactccacatccttgttagcattttttttaaatcatttcctttcatttagattctgtggaagagtttcttgggtttgtttcttaaataactaataaaattatattagtgatgttgagcataataaattcttacaatctgatccaatctttgtccaattaagagtgtggtggtgcaggagcagctcttgttttttttttttgttttgttttgttttctgttttttttttttttaacaatttcgttgactctcagagtctaagacttcagggctgggacctttgtccagcctgcacggtagagtgaggctgcctctcccaccaggcattgggatcctatttagaaacggcgttcacttcagaaggtactttttaactgctcagtttttgactattttaaatagtttgctgaaaactcctgataacacttgcagctcttgtttttaaagttgctttcagtttgagtatggtcttaaagacttctgttgccacactcctggtgcaacagcttccctatatgagccacaattttggtacttgccacttttataatgtataaacttctgggactttgttatatataattttatactactttaactgtggctattttccttttttaaagctttcatatctgagtgagaagatatggtgtttgactttatttttctcttatttcacttaatgtcatccagttctatgcatgttacagtgaatgacaggatttaattatcctttatggctgactagtattccatgtgtatatataccacattttctttatcaattcaacctgttgttgaacacgtaggtttattccatatcttcgctcttatgaatagtgctgcaataaacatggggttgcagatatttctttaatacaatgatttcccttctttgggatagattcccagtagtgagattgctagatcatatggaagtcctatttgcagttttttgaggaacctccacactcttctccatagtggctatactagtttatattcccaccaacagtatataagagttccatttcttctgcatcaacaccagcgtttgttatttatttttgtctttttgataataggaattctgacttgtgtgagatgatacctcattgtggttttgatttgcatttccctgatgattagtgattttgagcatttttccatatatttattggctatttgtatgccttcctttgagaaacgatgtccagataaatcactcatttttaaattagattattgtttctgtgctgttgtttgagttcattatatatcatggatagtagtcccttaccagatgaatagtttttaaatatcttccctcattctataggctgtaacttaactctgttgactgtttcatttgctgtgtagaagctttgtagttttatatagtctgatttgtctatttttgtttttgtggtcttaaccataaagtctttgcctggatcagtgtcctgcaacatttcctttatctttttttactagttttatagtttcagtctgatatttaattctctaatccattttgagttgattttttaatgtagtgagagatggtcttctagtttcaatcttctgcatatgaatatccagttttcagagcaccatttgttgaagagggtgtcatttttttcaatgtatattcttgacatctttgttgaaaatgagttgactgtaaatatatagatgtatttctgggttctctatcttattccattggtctgtgtgtctgtttttatacccataccatgttgtttttgtttttgttactattactgtgtattatattttgaactatctatattatattttaactaactatattatattttgtactatcgccagttttacccttttggcttggtattgcattgggtatttggggtcatttgtggttccagacaattttaggatgtttttccatttctgtaaggaatgacagtgttattttgataaggattgcactgaatctgtagactgccttgggtgaaatggtcattttaacaatattaattctttcagtccaggagcatggaatgtttttcaatttctttttatcctcttctatttctttcatcagtgctttgtagttttcattgtagacatctttcaccttggttaaatttatttctaagtgtctttttttgtagctactgcaagtaggattgcatttttaaattctttttcacctagttcattactggtatataaaatactaattatttttgtatgttgattttttttatcctgaaattttaatgaattcatttgccagttttaagagtattttggcagagtcattacatttttctatttatgagaacatgttgtttgcaaagagggacaatttgacttcctcttttccaatgtggatggcaatttcttactttctttttcctaattgttatgtgctaggacttctagtactatgttgaataagagtagtgaaagtgagcatccttgtcttcttccagttcttagagaaaaagcttccagtatttcttcattcagtataatgttagccatgggtttgtcatatatggtctttattgtgttgaggtatattccctctatgcctaatttgttaagaattttttatcataaagggatgatgaattttattaaaagatttttctgtctattgagataatatgtttttaaaattttatattgttaatgtgatgcattacatttattgatttgcatatattgaactatccttgtatccttggaataaattctacttgattaggttcattatgtttttgacgtgctgttgggttctattttctagtatttggttgagggtgtttaaatctatcttcatcagacatattggcccatagttttctttttttgttgtgcccttgtctggttttattatcagggtaatgctagcttcacagaattaattaggaagaatttcttaatcctcaattttttggaatagtttgagaaaaaatggtgttagttatttaaaagtttgctagaattcattagtgaatccatctggtcttggacttttcttttttgagagactttttgttactgatttaatcttcttatttgttattggtctgtttgattctgttcatttttggttcaatcttggtattttatacttgtgtctaggaatgtatccatttcctttatgttttttaatttgttggtgtatagttgttcctaacagtctctaatgatcctctgtatttttgtggtgtcagttgtaatatctcattgttcatttctgatattatttatttaggtctttttcttaatctatataatagtttgttgatttggtttacttttcaaaaactaacttttttcatgaatcttttgtttgcttttttgcctctaatttgtttcattctgtgctgatctttattatttattttcctctattaactttgggtttggcgtgttcttgcttttctattttttgaggtgtatcactaggttatttgaaatctttttttttttatataggtgcttattcctttaaacttccctcttgtactattttttctgtgttccataggttttttggtatgtcttgtttctgttttcatttctttcaagaagtatttaaaatttccttcttaatttcttcattaactcatttgtcattcaggagaatgttgtttaatttttatgtatttttacagtttccagtgttcctcttgttattgatttctaattataatccactgaaacctgagaatacatggtataattgcatttttgaaaaaattatttagagttgttttgggcctaacatagggtctaccctagagaatgttccatctgctgatgagaagaatgtacattttgtagccattggaaaaaatgttctgtaaatgtctattaggttcatttggtataaaatgaagcttaagtacaatgtttctttgttgactttctgtatagattagctgtgcaatgctgagggtgaggagggtgaggtgttaaagttctcaactattattacattggtgtctctatctctctctttaactataataatatttgccctatatatctgagtgctctggtgttcggtggatatatattaacaattgttctttcctcttgctgaattgattttttaatcactatataatgacctctgtgtctttttatctttttatttttaataaaagtctattttgtctgatataagtttgctacttttgcacactttttgtttgcatttgcagcaaatatcttgtttaatctgttctgttatagtctatgtgtgtttttaaatgagaagtgagtttcacaagcagcaaatagttgggtctcagttttttaattcagccagtttatatatttcaattagggaatttaaacggtttacatttaaggttgttattgataagatgaggatttattcttgtcattttgttagttgttttgtaattgctctgtatagccttagttcctttcttcttttattatttttgtggtttggtggttttctgtagtgataaaattttattcctttctttttctcatttgcatatctgctttaccagtgaattgtatactttcatgtttttccttaattgataggtaacatctaccaatgatatagacacatatctgcttttgcttaattgatagataacatcctttcgctttcagaggttggagtcccttaagcatttcttgtaggttcagtttaacagtgattaattccctcagtctttgtatgtctgggaaaattttatgtctccttcatttctaaagaatagctttatggtttatagtattcttagttgaaagttttttcttttttttattccagcaatctgaatatatcatcctatcctctcctagcttgtaagtttcttctgagaaatctgctgttagtcggacaaagataccctcatatgtgacttgatgctttcttttggtgtttttagaattccctttttgtctttactttgacaatttgactatcatgtgcctcatagaagacctttttggatttaatcgatttgggaacatttgagctccctatatctagatgattatctcccaagagttggaaacttttcagctattgtttcattaaataagtggcctatttattttctcactgcttttccttctggaatttctaaaacaggaatagactatttgtttgcatagtgatatcccatatgtcatgtaaacttttttcatttttattcttttttctctttttgcctaattcgcttatttcaaaagatctgtcttcaagatcacaaattatttcttttgctttatctagtctattgttaaacttgagtagggtgctttggctttgtttctgggagaatgcagtactgtagtcaccatatgatttcttcagcattagtccaatcagtagtatctatggcttcacagtgtcttatgctctagttgttcctgaaagctgtgatgtgactttactggagatggggcctccaggcaagcagtccttggatccctggggagtgcacacgcacctctggtggtacacattgcatggaccagttctcaggatcctgggtggtacacaaaggtacatagtggccctgttattgctgggccaagtttgctgggttgtgatggtggcacatcccagacagggcagtccttaagccctaagtggcacgtttggggatcagtgttcatggcagtaggtcacaagcaagctggtcctcaggcccctgggcattgtgtgcaggcacatgatggcccaattgctgcagggaacaaggtcactgtcatcagggaaggtggctctcaggctcttggaagcatgtgctttggatttctatgtcctggggagagcctccctgacgtgcaggactgcctattccctgggatttaggtctctgtgtgggctcaggtaacagagaccctgtggcaccattaggttcagctggtaatgtaacactgcaaccttctgggatggtgtcgggggatgtaggctgtgcacctgtgatgtggagatgcagcagcaattaggccccagggcaggatgtagtctggtgtgacacttgttagtgcatttttgatggcattgaaagttaccttggtgttactaagccaaggtcaaagaacattgtgatgattaatgctgaaagttattttttcataatttgaagattttttaaaatattaatcctggggccaaacacattaaaggaattaagaagaaataaatctggaaaattaatgtagacacagaatttaaaatgggaataaatacttttacacattcagcaaatacctattaagagacttcaggcaaaactatggaagtaagaggtcctattaagattctacagcaacttagggaaaagaaagttacttgaactggcgtagtagcagtgaatatgggggaaaagtgaacatatttaagaaaaatttaaaatatagaataaaacacatcttcaactatccttcaatactacagttcactaaaggtcaatgtgatattataatcagaacactccacaataagggaataacattgctaattctaatttagaagtggtcaatctctttttcagaaaatccaaaaaccattgtcaatcgcttccaccaatcctcatttgatctccaccaccacagttcttttgcaagtaatctcttccactaccttttactcattgttcaatttccagtacctttcatgggatttagcactcataattatggaatattaaataaataaacgaaggaataaataaaagaaaggttgtatttttacaaacccttatatttaatcagttcttagtaattgttgaatagttcttatggtccaaatcattcatcccttctatcaaagtttgtagctcatgatgagtcagtttatgcaaactgacctctgaaaatatatgtttaactatcatgagacatttgttgatggtatgaataatttttaaatgatcattgaaaaactttcagttttaaatatataactgcaatggataaacagaagacatttgtcattagagatacccttatttcaagaatctttagtcaatattggaccattgaatcatactaaaacataattataagcaaatattttaccacatgtgatcttcctctgtggtaataacaaaaaaatagtttaaagtctaagagtcctttaccattgattttaaatttttatttgtatttacattttaatgtagagagagctgatattctgagaattcacacgttttcacaaatgattcagaagaaaatggaaatctgttttggacccttattccctatatctatctatctatctatctatctatctatctatctatatggaaaatagtctctccctctctgtctctctctctctctctatatatatatatagtattagtattgactcctgaaagaaagcccatgagaggttaaatgcttataaaaaatttgaaagtaaaattttccctaagtaattcacaacacagatacgctaagaactaacttgtcaattgatctacctgacaaaagaggaaccagaagtctctgaatacaaaacaacatatcactctaaaagatcattgtattagtccattctcatgctgctctaaagaacttcccaagactgggtcatttataaagaaaagaggtttaattgactcacagttccacatggctagggaggcctcaggaaacttacaatcatggtggaaggggaagcaaacacatcctttttcacatcatggcaggaaggagaatgagagcccagtgaaggaagaagcctttataaaaccatcagatctcgtgagaattaacctcactatcacaagaacaggatgggggaaaccacccctgtgattcaattatctctacggggtccctcccacaacaacatgtgggaattatgggaactataattcaagatgagattttggtggggacatagccaagccatatcaatcattcttcacaagtaccagataagttatttgctattaaacacatctgtaacttttctaagaaaatctgtcccctacagaagatgcaagattgtgccaattctcatcacagctattcaaactatgattaattatctggaaaaaaaaaaaaaaaaggtaacccatctattcattggttttattttggacctacagcatctaggctggtacaaaaaagatctagagggccagctagattctttctcttttgtttgactgggaaaattctgagagaagatgccataatctgtgggagcagatgttgaaaaattatgatgttacaaaaagatcactggtaaagaatcatggctaaactaatataagataagcttatgaaggcacagaaacttgagagagcagtggaaaccactcagtattttaggcaaacatgtctgcttgactgtttaatggccatttctctttttttactaacaaatctctgattttgtttgtgtagtaagtgactagtaataaaggttaaattgtggctggtctaagcctagtgttcaattagaacctgtttattccagctcacaagagccgattctatgcatttcgtaccaactcagagttcagtgacatcacattggtagcttaaaacctgcaaaggtgggggtatttatgccacagaaataaacaaatgctacaaattaggactaccactccctctggcttctagtcagttgttaatcacttatcagcaccctctaaactcatcttggaaatctaattttcttttgccggtaattggctcaagattgagagaggaaccaagttttgacctatgacaagtaagagaaactgatgaaaatcatctgggaaagactttcttctctaaagttaaagctgcaagccagcttctttttccgttttaaattgtgttgtgtaatgtttggagatgcaatgctttaagatgcaaccaagagggaacatgaacagaattcagagatgcttacacattaataaccttgaactgggccgggcaaggtggctcacacctataatcccagcactttgagaggtcaaggcgggtggatcacaaggtcaggagttcgagaccagtctggccaatacagtgaaactccatctctactaaaaatcaaaaaaattagccaggtgtggtggcacatgcctgtaatcccagctacttgggaggctgaggcaggagaattgcttgaatccgggaggtggagttgcagtgagccaagattgcgccactgcactcaagcctgggtgacacagagagactctgtctcaaaataaataaataaataaataaaataaccttgaactgtcagaggcatgtgaatcagaacaactccatcttgaataggagcttggtaaaatgattttgaaacctactgggctgcattcctagacagttaatgcattctaagtcacaggatgagataggaggtcggcacaagatataggtcataaagaccttgctgataaaataggtttgcagtaaagaagccggctaaatcctaccaaaaccaagatggccacaagagtgacctctgctcatcctcactactacactgccatcagccccatgacaatttacaaatgccatggcaacatcaggaagttaccctatatggtctaaaagggggaggcatgaataatccaccccttgtttagcatatcaccaagaaataaccataaaaatgggcaaccagcagttctcagggctgctctgttaatgaagtacccattctttcatttctttactttctcaataaacttgctttcactttgcattgcagacttacccccaattttttcttgcacaagatccaagaaccctctcttggggtctagaatgggacccctttcctgtaacagaaatattaccaaccagggcaaccaaaatgcagaaaatcatgagcagtccaccatgggcatagaaaataatgtgcgttttctgtacagaatttaaaaataataattaaacatattaaccatcagtctactttttattatcctcctgtacggacaattctaaataatgttagccatgaaaatatccctctccacatagcttaactgctcctacccaagtcctccgtttgctagggctagtaaccctaaagccaagtatatcaaacatctaggtatatgagataaggaagggtttttgttatttaagtaacctttacatgagttttctgtttcttgtttatgttttgaactgcttaagttgtccatgaaaagaagcagatccagaatatcggtatatcaggttaatctagcactaaagggaaaaactattaattcctgctttaaggacctacaatatccctggatcccaggcctcccccagctctaatcatgcaaagattggtaaattatggttccccttgttgcatgtccagagtattctccctatgtgctgtcagtattactatgctaaactacctctacattgatgaatgtaagtaggttcctttgccttttaaccaaaagaaccgagaaacagaacctactattcaacagtcaaattacaaaaggcttttccaatataaggtgttgactgaatttactttgtgaagtctatatgaaggagatagcaaatagacaaaaatatgcttaatgttgttcataataattaaaattactgtttaaatgttaccaaaagagcacataaatgaataagttcttgaataatatacaatcatgcagaaatatgcagccaaatatgtgtaaaaaggcaagtaacataaatatgcatatatacatgcatgatacacatttgaaaatataaatatatattagaaaaatggtgaaaggaaaaaaaatcagttagcagtgattattattcctgagtagtggaatcaaaggccattaattttttttcccatacattttctatatttccaaagattttgattctataaaaataaagtagtttaaaaatatgtaattagcatacatttcattttcactaatgtatcatgaaaatatagttggtttctggaataatttttcattatgagaatgtatacatacatgaaagtaatgaagtcaataggttagactggaacaaatcaggtaactttaaaaaatgaagttggatattcatgagaatttgcattttataagaaagaatattatcacattccaagaaaatccttctcttacaaaaaaggaaaaatgtatatataatttattttagacagaggattactttttgagagaataaaaaagacgaaaatgtgttcacttctttgttcttacaacacaaacaaaacttgaattatgcttctgaggatattgatttatgagtatcttcacaatcctgtgggatattattctaatttgtgatgagataataatctgggcttcacatggaatctcaaccttgtctgttgtagttagatatttagacttgtttgtttaattctttagattagcactgtcaaatacatataatggttgttgaattatcatattgcatctgtgaaaggaaaataaatcttggagccccaaaattactaagccaaagggaaaagtcaagctgggaactgcttaggacaaacctgcctcccattctattcaaagtcatctctctgctcagtgagataaatgcatatctgattgcctcctttggaaaagctaatcagaaactcaaaagattgcaaccatttgtctcttatctacctatgacctggaagcccccttcccatttctacttgtcccacttttgcttcaatttgttccacatttctagactgaacctttgttcatcttacatatgttgattgatgtctcatgtctccctaaaatgtataaaactaagctgtgctctgatcaccttgggcacatgtcatcaggaacttctgaggctgagtcatgggtgcgtgtcctgaactttggcaaaataaacttcccaaattgactgagatctgtctcagattttgtggttcacacatttcaaatcgatgatgttttctcactaatatgtttttttccatgaggggagaaaaatttggttggaaaagaagcgcagggaaatcaggatttatttgaaaatctaggaaaaacctaagattctaggtattattttctaatatgttttggccatgaataggagtttcttttatagactcagtgtaaattgttaaatttaaaaagattacaagaggtcaggctcataatcccagagtagaccatggatgacacaactgctgctaatacatagcaacatattgcatccaaaaatacaatcaattaaatgtttactggattaaataaaattaatcttatttagtattattcttttttttttttttttttttttttgagatagagtctagctctgttgcccaggctggagtgtagtgacatgatctcagctcactgcaacctctgcctcctgggttcaagcaattctcctgcctcagcctcctgagtagctgggattacagacgtgagccatgacacccagctaatttttgtatttttagtagagcgggggtttcatcatgttggccaggctggtatcgaatccctgacctcaagtaatccacctgcctcggcttcccaaagtgttggcattacaggcatgagccaccatgcctgtcccagtattattctattttataaaattgacaagagaaaataaacaaattaaaagaataaaaacataccagatacagcaaggaagtcatcaatgcttgtaatgtcatctacggcttcagtgaggacatgtatatgattctcccatgtacgcttgtacatttccatggtgtttttgaccgcttgacttttgggtcttgcagccaaagcaagtgcagcattaataatctataaagataaggattgaaaaaattacctattggttgcaatgttcactatttgggtgatgggcacactaaaagcccacacttcaccactatgcaatatattcatgtaagaaatctgcacttataattcctaaatatataaaataaataaaaaatattaaaacaataaaataaaattaattaaattatactcattcatgttaaacataaaaaatggaatttaaaaaaatctgtaaagatgtagaacatttactcagtgatttatttcaatacattaagtgtattaaaattagattatttaaattaaattatggttaaatacattcatcatcgacaataggaaaaacagtaaaatgtctccatatatacagtttatattgaaaagtacaaaacgttttatatttattagtataaattatataggtataaataataatttttatttttaaaattttcctactccctctattattgcagagtgagttttttaaatataaactttgttaccataagctccatcaagttcaagacacttttctaagtgatgatatcaggcatttaatcaatccttaactgatgattctggtaatttaaacatgccaatccagtcttttttacattattaactggtgagaaatggatgcctttaacagatttttttttcaaattagtaaacaaaaagaaatcagaaagaaccaaattaggactgtaagttgaatgcccagtgatttcccatggatattcctgaaacattgcccttgtttcaggagagaaatgagcagaagcactgtaatggtgaagaaggacattctgttgacacattcttgggcatatttctgttaaagttttggttaattttgtcaaaccactctcaaagtaagcagatgttatcattctttggccctccaggaagtcattaagtaaaatgcctttagcatatcaaaaaactgttgccataacccttgttcttgactggtctgtttttgctttgactggatcacttccaactctcagtagccattgctttgattgtgatgtcttcagaattgtacttgtaaagccgtgtttcatctcctgttacaattcttcaaagaagcaattcaggatcttggtcccacttatttaaaaattccatcgaaagctctgctgttgtctgcagctgatctgggcaaaatggtttggatactcattgagtggaatgttttttcaactttaattttttagtcagaattgtgtaaactgaaccaattaagatgtctatggtgttggctattgcttgtgctattaatcattggtttccttcaattagagcatgaataatataatatttttttaatcacaaatggatgtggatgggctgcttctgtgagcttcatcttcaacatcatctcatctcttgttaaaataagttatcagtttgtaaactgaagatttatttggggcattgtctctatgaatattttttaaagcatcagtgatttcatcattcttccactcaaactttgccataaatatgatgtttgttcttcaattttagcagagtttatgttgcctttcataggggtttgatatagtttggctgtatttccactcaaatctcatcttgaattgtagttctcataattcccatatgtcatgggagggacctggtgggaggtacttaaatcatgaggacggttacctccatgctgttcttatgatagttgagttctcacgagatctgatagtttcataaggggattttccccttttgctcagcacttctctttcctgccgctacgtaaagaaggacatgtttgcatccccttctgccatggttgtgagttttctgaggcatccccagccctgtggagctgtgggtcaattaaacctctttcctttatggattacccagtctcagttctgtctttattagcagcattagaacagactaatatagggctcttttcaaactgatgtctctgatttttaacccgtcaaactagatcctgtccacgcacgttatcacaagttagcacaagtttatttttgtgcaaaaatgttgaattctatgcataattttttcataaaacacattttcagtaaaggttttgaagacctctcatacaatgacaacaataaaaagaagctttttctactgaatatcctaaagactgtaccttaagtcacttcctgtcaccacattattggaggtagaagacggaaaaaattagttgcctgagaataatatatttaaatcctctttttttgtttcttttctacaaaagaggaacatattaaattttaaggaaacacactaactttagaaataactactgtgcagtatgccttgacttcagttttagagttttattaacctattaacttacaatgtaccttcgtgtatactgcagtggctctggtccctggtgtttcattgttcttgcaattggacagctacgtacacatgtggttgtactgaaattatgccttcacagcaaagtatacttttaaagtactggtgtaaaaccctcagtggagatatgaagttatgaatataagacaggctacattttataagaatattttcagttctgctgctgatccaatttatctgattcaacactgcacactatgaagaagctttatcctacttgactcttgtgatatttagcttaaatctaaaagaagacacaattcagaagaattcttctaaccctctttagggcagaaaaatgttcatcccaatgtcacactcctagaattttagccatatatctagagaaaataaaataaccattcttaaatcttcttcacgtaaaactaaagcttttttttaaaatgaattatgttgctttctgaggcattttgtttctttaaattatggttgaaatatttacatgtcggtcacttgaccctgataattatctagtctgtcagtttacctttgaaacagtctcttttgagttcgggccttattatatcttaactgggccattctagtagccttgtaggtttctacttccagtctctatttgctcttagacattctccttaatgcaaacacatttctttctcaaatgccgaagtgatcatgccccccacttgctgataacctttgataaaatcctagttgactaaaaacaaacaccatatttcttttcagtaattcatagtctaaaaccgtccccaggttggtccttacctacagttcattctgctgtaataatcttactcattttagtctttgttccagccacagttttaagctccatttccttatcacaccactcatctttgtacctctgtgactgtttttagagctgaatctgccttaatgcccttgctccatccctttttctgctctactccgtctcaggaaacatttttcatacttaacatatccatggaaatatcaccacatactgtgaagcctgtttaaaaaatattttgtccatataaataaatagtagttattctattgcatgattgctcgtacacatgtctattcctgggtaatgagctccattataggagggactatgtattattcatctttgcttcttggtatactaaacatgttaattaccataaatgctatacttacaaactgtccctaagagaaactattctgctcgcagcccacactgagaggacagccacaggagggcaggtttggtattattttctcccacttcaacactatttaggtcataggcaggtacccaattcaagaagagttaatctgttggctggctggtgatggttatgaggtttgacataaaaagttgtgttgtgttaatcaatcttgaaaatttgaactagaatttatggagaaatcattagttagcagtcaagatcaaagctgaaagtttctgtaaagagcagccatcttataaaatcagaaccagagggggccaatggaactgaggctacaaggaaactagagccaaagtgcaaggaagaagaaactgtaaatagactgaacctataatgtttaaaaagaaaaaaaaataggccaggtgcggtggctcacgcctgtaatcccaggactttgggaggctaaggcaggcggatctcctgaggtcaggagtgcgagaccagactgaccaatatggagaaacctcctctccactgaaaatacaaaattagctgggcgtggtggtgcatgcctgtaatcccagctacttgggaggctgaggcaggagaattgcttgaaccagggaagcggaggttgtggtgagccgagatcgcaccattgtactccagcctgggcaataagagcaaaactccatttcaaataaaaaaaagaaaagaaaagaaagaaagaaagacaaaaataaacaggcaaaagcaaagtgtggagtaaaataagccagtgggtggcaagaggagaatggggaaaatatatcaagagagtcaataacatcaacagagagaaaatgatactcagataaaagaaaaaaaaagaactaggagttgactgtttttgagagtatcctattttggattacaaggccacagaaatgctaataacgataataataaaatactaacaaagtccatactttgcatcatgcaccactgttccaaacactttctacatattcacctaatttttttaacctaatttttacaccacaatgaggtaggtaggtgttgtcatctccattttcaggtaaggttaccaagttattaaggagaagttgtcaacttgacctagacttcatgctcttaattgccacactgtactctcttctataacaatattatactaatttatgatgctgtgagtaagtgatgatccttgaaaccataaagccatcactgaaggaaacattacaatgcctggtgtaaagaaaaacaaaagagagagagtgtgtgtgtgtgcatgtgaaagagagagagaaagaatatatatataaaattcgctaagttaaccatttataaaactcagtggcattaagtacattcacatagctgtgcaactatccatctccagaactttttagcacatcaaactgaaattctgtactcattaaacaatagcttcccattcttccttccccctagtacctagtaagctctattatactttctacctcttttgttgactattctagatacttcgtataagtggaattatacaacatttgttcttttgtgtctggcttatttcccttaacataatattttcaaggtttattcaagttgtagtatgcatcagaatttcattacttttcaagattaaataatattctacagtatgtacatactatgttttgctcacccattcatctgtcagtggacattgggttgtttccatattttggctgttgtgaataatgctgttatgaccattgttgtacaaatgcctgctcaagtcttggcttgcaattatttggggtatatgcccagaaatggaattgctggattatatgacaatttttttaaaaaggggtctcactctgtcacctatgctggagtgtagcggctcaatctcagctcacagcaacttccacctctcaggctcaagcgatcctcccacctcagcctcccaagtagctgggaccacaaatgcgcaccaccacacccagataattttttgtatttttgatagagacaaggtttcgtcatgttgcccaggctggtctagaactcctgagctcaggtgatctactggcctcagcctcccaaagtgctgggattccaggcgtgagccactgtgcgaagactgacaattctaaatttaatttatgaaatggccacattgttttccacagaagttgcaccattttgtattcatatctgcaatgcccaagagttcctattttttcatatcctggccaaaacttattttctcttttgttttttcttttaatcccaaccatcctaatgggtgtgaagtggcatctcattgaggttatgtttgcatttccctaatgattaatgatgctgaacatcttttcatgtgcttattgacgaactgtttatcttctttggagaaatgtctattcaagtattttgcccatttttaaattgttttttcttgttgacttttaggagtcctttacatattctggttattaatctctgatcatatatatgatttgtaaatattttctcccactctttgggttgcctcttccctctcttgctaatgtcctctgatatacagaagttttaaattttgatgaagtccaatttttttttccattttttgtgcttttggtgtcatatgcacattgccaaatctgatgtcacgaagtgtcactctatgttttcttctaagagttctatatttttagtcactatgtttaagtctttgattcattttgagttaagttttgtatatggcacaaggtggggcaaacttcattcgttgccatgtacttgttttcccagcaccaattgttgaaaagactatcctttacccatagaattatctgggcagccttgtcaaaaatcatttgactgtaaatgcaagggtttatttctgggatatcttttctatgccatttatctatatgtctgtatcacactgatttgattattgcagtttgtaatgaattttgaaattagaaagtgtgaggcctccaaatttgttcttatttttcaagattattttggctactcaaggtcccttgagattccatatgaaattgaggatgtgtttttttctatatgtgcaaaatacattgttggtattttgatagggattacattgaactggtacattgctttggttagtattatcatcttcataatattaaattttataatccatgaacatatgatgtcttttctgttttttatgtcttctttaatttctttcagcaatattttgtagttttcagcaaaaactacaaaggaaaagacattcaggtaaaagtctttcacctctttcgttaagcttattcctaggcatttcatttcgtatgatgctattattaagtgaaattgttttctcaattcccttttcagattgttcattgttcgtatacaaagacacactgatttttgtgtgttgattttgtattctactgaattctgttattagttttaagatttgtgtgtgtataatcttcaggattttctaaatataagagtatgtcatcactgaacagtgataattttatttcttccttctcaatttggataccaccaaaaaaatatataagtttttttattcgtttaaagttggattttgtcaggcaagtaaaaagaaaggaattaattggattgattgaggttataggaggagtacacagaactccaaggaactgctgaaagcactcaccagcctccttttaaatggggcttctgttattccaaggacattccctgcccacgctcgctcataagggctgtgtttgatcctcatttctctttcctcatagaggcctgtccaaattagctcctgttagaccctgtgcattaggttgtctgacaccccagaccaaagccagtttagttagcttcagctggtcccattctatcttctttaggcttctccccatttttactggtatatatggccaagacctcaacatgcttcaggctaagcttcctcatatttttctattaaatcagatagacaacttttactacattctaaactcatttaccttgggaaacccttgaacatctaaactacgttcagaatatttaggattttcagactgtctcaagattttctttgtgtccctctaggtattagaagcttgtatttacaggcatctcatttgtacagacgccttctaagacccataagagactctagaaatgtgttcacattgtcatttattctagtaaaacctgccacaaatagttttgggatccagctaaggggaagttgagttgaggatacatttagtttgtgtttagtgggtaatttcaggtgttttacagtcacttccctatattttttaccaccttcatacttgtggtattgacatcggatcatgatagaaccaatagagactttgcctgtcctaattatatgtgctctcctttctgaaacaccccccaaacaaactatgctaaaacaaagactgaattatcttctcagtttctacatagaaagtgacattacaaaataacttgttgtcattttagaggtgatcaagagtgtgcagtgaaagacagaaaaaaagaaaagaaaaaagttttatgagggtgtatctgacacatcatttatacaaatgtattatttttctggattttgctatattttgatatttgacagcattttaaaattagtatctagttggtttttgttttctaaataaatattcactttttcttaaggccctcaaaactctgtatactttaggctccacacagcctggcctatcacaatcaatgtattatttatttattataatttttttgagacagagtttttgctcttatcaagcagactagaatgcaatggtgcgatcttggctcactgcaacctccacctcccagattcaagcaattctcctgcctcagcctcctgagtagctgagattacagatgtgtgccacagtgcccggctaattttgtttgtatttttagtagatatggggtttcaccatgttgggcaggctggtgttgaattcctgacctcaggtgatccacccgccttggcctcgcaaagtgttgggattacaggcgtgagccaccgagcccagccaaacagtgttttttttttgttttttttttttaataaaaaaacctatcttctgaaatgataaaatgaacacatattcaactgcaatatttttattctttacagagaaaaatgacttctttcccttcaccttccttttgatgtgacagtggttttcttcaaaaaagttattttgcttttactatatgtgtaaaaatggaagaatagtgtaggagttataaaaataacattactgaggacctgcaatgtgccgggcatgtttctaattacttgatttgtattgtttttcatcccctgagaaagatcttatcagtatctccaatgtgctgacaagacaatggaggcacaaagagatgaaataacttgcccaaaattatagaagaaactctagattggaagccaagaggctcaagttaaagtttcactttgctttaaactgattttatgcccataaaaaaagtcatattacctctccaggacctattttcacagaaatacatgtatgcatacactgaggtggggtgtggagacagggtttgaattagctcatgccttagaggttcttcagattttaacatttgatttaatgctgatgtatatacttctcttgaaagatttctaaaaacaattacttaaaaggtgaaaataaatctacgtaatttaatttttcccagagatagttcaatattggcattgatacaaataatcttaaaaattttacttaatataacaaaagcactttgtggattaaaaagatgatttatatgtagtatctataggtctgattacctcagtggcacggcaagtagagaaaattaaaataactagatatatgatgcctcgaatacatctaaggttgtatgtgaggtgaatttatgtaacaaccacttaaattggtaacatcatcataatttcagaattctagcaactggagtaatggcatcaaattcaatgctctaactctgttcatccttttctcagttgcttaaatgatgttctactactaccaaatatttctcactttctacgtagtttttccacatttctttattttgataactttttctattttacctgctctcatactatacttcatctatggcaaattacctttacacttcaaattacggcatgtaatacttcccaccatgaatctccatgtcagaactttatgttaaatgataaaagcatttcagagtaggggagggtgtggtgctgaggagacctaacctgccatggactccaggtttacaattaatgaaactgcattcaactttggcctcacaaccttttttgtaatcttcttactccatgaagggatgatccctgcatgatgggatcactcacacggaaacttctcacaagactctcatttgccttggataaacgtataagaaaccaagctatcctattctaggggttaaaagtattttttaagaggagaaggggacaaagtttatttctgggaggatagagctttctgtgaaagtatatgccagtataaattttcgtatctcataaaacatactgctgaagaggaaaagttcaacctaggactatttcggttatggaaaatgtaataagtgggaaaaataatgctcccgggaggtctgtaaaaggcaataattccacatgaaaatcaaaacatttattttactgtcttttacactaaatattaagattggacaaccttccaaattaaataagtaaaagaggaaaagaatataaaatgcattgcttgtgatgataaaacaaaatcaccaatacgtagggtttgtagactaataaaaatagaatttggagtgaggactcccattttaatccagctccagtacttagttttgtgtggttttagacaaattgcttactctctgagcctcaatttcctaatctgtaatgatcattaaaatgcttgttacaaaggttgttggtagaattaaattagattatggtttgttcgtttgtttgtttgtttttgtgagatggaggcttgctctgttgcccagactagagagcagtggtgcagccccaaaaattcaagcaatgctcctggctcagcctcctgagtagcttggatgacaggcacttgccaccatgcccaactaatttacaaatgattgcttctataaagataatttgaaaataaaatacaagaatgctttagggatttaaaagaatactatacacaaatatatatacacacagaatttacaattttgttgaactcaacaatcattttaatattccaatttttttaagtctgagttaaataaatataaataagaaaaattgaatctacacacaattttttagggttttcctgtaacataaaactaaaataagagaaaaattgccttaaaactatctgataccaataacacatattacagtttaaagtaataaaaatactttaactggcaatgatgaaaaaataaatataggcaacagagattttttgatccattataatttgctactcagagatttaataagtttagaatttggagtggaaaaaaattggtactatctcccaaatcatttcagttcaaatggagaaatttaaaatgaatttaatatttttgccaaatctcctttttttaaaggacttttatgtcagaaacatctacaaagtttctctttaatgtaccatccaatttcatatagacataaagtcaaaatgtaagctattcattaattgccaaagtgtgtttcatataataagaggttggcaaaagttaaaaagaaaaaacaaggcctggcgcagtggctcacacctgtaatcccagccttttaggaggctgagggaggtggatcacaaggtcaggagatcgagaccatcctggctaacatggtgaaaccccgtctctactaaaaatacaaaaaattagccgggcgtggtggtaggtgcctgaagtcccagctactggggaggctgaggcaggagaatggcatgaacctgggaggcggagcttgcagtgagctgagatcgcgccactgtactccagcctgggtgacagagcgagactccgtctcaaaaagaaaaaaaaaaaaaaggcatgtatttgaaatgcctgacagcttgggattagacatattctttgtagacttggattcagctttggttttagcactaagaagagttcacataacattaagaaatttaactttcttaattgtcaaatgatttttgctctgtgtctaccatttatctaagttagagagcataagacaggagaaactcagaaaatatttcactttaagtgttctaagggagaaaagtcacgcataaatattcaataaaggacaacacgtatatgaaatctatgtaagcaatgttttccctgagttgcaagggcatgttaagaaaatatgagtacaaggtacaaatagggtcgaaatagttagggttgacttctctttctcattcctctctcattgttcatgctcttgcatggtctccttctctctccttctgatgggttcctagaaattttattaatatccttgacctagtattttgacctccaagatactatgtccactgccacaaccccactctacacgatcattatctctcagtgacaactgaggtagctttagttctgttcctagccactctctacaaagtgatatttccaaattactaatttcacaaaattcctgcctcctcttttatcataggatcaaagtcaaagtacttaatttagcctaaggccctgaaatatttggcccctgtttatttctctagcattatttcctatcagcacccctcgatttccactcttctttgtctaggggcatttgtctatgcttttctttctgtagggatttacctcttgttaggtaactccaatttatccagcagggctcacctaaagcattattttctcacgaaaactttattaaatctaggtcagtttcctagattgtcacggttgagcatttatcacactacctcaaatatatcaaatctaggtcaggttcctggattgtcgtgggtatttatctcaatatctcaaactttatcaaatccaggtcaggttccatctagggtgagtattgatctcactatctcttctcattaacgagatgttcattagagtgatcatctgatgaatgactaatctctactttccattgttataaaaaagcagtgatcttaatgtctttatgttattttcccagggtacgtggaaagtgccaaatagaatccctcttcccatgtaaccagggctccagtctaaggctccttctactttgcaagcctactaatttattaaaggcttttcccaagtgatcaagtctatccctacagcgaactcttataccagtagctatggtgatgaaaatatgtctatatggtcaggtatggaggttcacgcctataatcctagtgctttgggaggtccaggtggaaaaatggcttgaggacaggagttcaagaccagcctgggcaacatagcaagaccccatccttacaaaagagttaaaaaattttttaatgtacgtatcattttattttatttataactctgcagtcacaaaaaatagggccactactaaagtgcatattcaacagcaaagtgttcatcaaatatccatattaagctattctaaagattattccaagtgaatcaccaggctttccttgttgatccatcctgtgctcaactctagtgagtctcgagttagcaaaaggtaaacattaaagtgtgatttcccccatggaactgttatgctcaaaaactgaccattttgctatttcttcagattttaattatattacttggttagctagaggtcagaacaggaaaataagaatgaattcaagctggaaaggccatttagaaatactgtagcaattttaccacacatttaaggtaagaaaagctctataatctatttaaattgacctgaaacaaagttctttattaccagtataggtggtagattaaaaatagagtataataaaaatagtcagatgctactattaaaagagaatattggattttcccaactaggataggattttataaaaatcatatatatatatatatatatatatatatatatgtatatatatgatttttatcatatgtatctataaatcatacatttatgtttatatatataaaagagaaataaaattccctgagaatagaataatgtctttcttaaattagaagctttgtctatagtttgggcaacccaatctttgtatctttttattttaatcagtcaaattggtaatatataaaattattcagtaaattatatcatttataataatttaataaattatagtatttactgaatagcaaagatcattgggagtgattagaaaacataaattaactatacgaacttcatgaattactatattaaaattaaattatttattttctaaagttatgaagtattaaagtttggaaagaacatattttccattctggaaatggaaaaaaaagcatgttttctcattaaataattacaaacatttccatttaaaatttactactctattggagaattcttcttggcctcaacagattgcaaaaattgctaatgtttatttcattctccaggacctggagtccttaattgctgatgcatattcactggcgcatgcaaagtactgcagtgatgcactacttattgtaataattacatattaaagaacctatggcctacattcagtcagactcactttgtgagtttacttcttaagggggaaaaaaaaaaccctgaattaccagttacaaaatgagttagttgatagacaaaaattacccaaggaaaacataatcaataatatacactggaaaagagctcctctttgttgagcacagatctgcaatttgtaatttaaagtgttatttattttgttcagggcaggttgagctgtaacatgccgtgtaagagataaatacggctatggttcttaattacagactttaattcaatgggctatgtatagaaccaggaataaggtactactgtttcctgggagttggactatgtaaattagattgagtagtaggacacaaagctatgaataagaaggaattatctccggggaaatataggtgacaaacctacaatggcttttagcatctggcaggttctatttgaagagctaatgtcattctatgtaatggattaggaagaactggatgcactccataatgcaggccaagcataatttccatgatgactgagtcttctaacatatcagacactatagctgccttcaattttctagtctcattttcaaccctgtggtgagggatggggagggagaagtctgtatttctccatagtcagctgaggctacagcagctgtgaaagcaggatttgagggataattaacatgtagaattcatagaatcatgaccagttgaatgtgagagataagaattatgaaggaatcaaggacagtctcaaatttatggcttgatgatttaattaatgattatttcagtgatgaaaataaagaacacaaaatatatggtttgggtgagcaaaattattagttgagttatagacatgatgaaattaaaatattgcagcaaatctatgttgagatacacagatatcagaaacaaaatctggggaagaaaaatagatttttagagtcattgacatagagagctatagattgttgttgaaacagggtgatggattcagtaccaggaggtgaaacgacatgagagagagagagagagagagagagacagagacagagagagacagagagagagaaattaaaaaaggtaatccttgtggctcacacctgtaaacccagcactttgggaggtcaaggtgggcagatcacctcaggtcaagagttcgagaccagcctggccaacatggcgaaactccatctatactaaaaatgcaaaaagtagctaggcatggtggtgtgcacctgtaatcccagctactcaggaagcagaggcaggggagtcgcttgaaccccggaggcagagattgcaatgagccgagatcacgccactgcactccagcctggtcaacagagcaagactctgtctcaaaaaaaaaaaaaaaaagtaattccagtattcatgaatgtagacaaataaagaaatgcatccaaaaggaaatgctcagagtagtaataatctcaacaagaagatcatggtcaataggatcaaatactgaagactagtcaaataagacaaagaaataggggttcctaaattttggtacttatgcagatactaatgcctttaacagagaagttaaaggtagaaaacctacaacagtagcctgaaagtaacatgatgagaaaaaaatggatgatagagtagattatttgtaattgaacctaagtttatttcataggtacttattcttcattgagcgttgcactaaattatacactgtagttctttgtacctctctctttctctctgtcaaactctctctcttctattatacaactgggtatataggaaggaattttatgtatcctaaaatgtttaaagtgacatttatgcggtgaaaataagcttcactcttctgggtcaactgtgaaatagcataaaaagtccgaggttaaattagaagcaaagcattttctgtcaaacacagtttttactgaaaaaaaaaaagacttacataaaatatataactatgggtggctcatttagttgtatatggcagaattttttctgtcctctttccaaataactcgagtggtttcttcagtttgacaaatagttataaaaacaagtttgcagcataaaagaaaaggtggcaatcagctcctgcacaaaaactgattattaacttaaacaagtcatagaaactaatggtcaggattgcaattacagtcacaaagaccagaccacatctttatgtcagagggcatagagttcactcacattcaaggttcaatatgtttgaatacaaacacaagatgggtgattacacagaacccagtccatgaggtgacttcattcattaaccttggaaaatcctccattgaaattagacttttcttagtttatcgatgtttatgtgagataaactcaaggcaaacttgtatgacctcaaccatttcccttgtcactcaaggaaagggaattatttatttattaaattataaatgtatttataataattataaataaattgttataattttatttttaatttatattttatattgttataaataaattataacaatgaaaacattcacaatgctttaagaatggagtcttagccaggtgcagtgctcacccctacagccttaatactttgggaagccaaggctggaggatcacttgagaccaggatttgagaccagcctgggcaatatagtgagacccccatccatatgaatttttttaaaaaacttctctgtgaagttactaaaatcagcaaaaatgggttaatattctcctcaaagcagaaaaaaaaagatctccatagttcccaggtttttctttaagaacttttactatattgaaaggataaaagatctgtcattcctcagagcatatcacaaagttatcttccaaaaacaccctccacaccatcactacatggcataacttccctatcatgaagtagtaaagaatcaatcatagatattttcttaacattggataacacactgtttctcagggactgtctgcttaagggttttctaagacactatggcctcattgcctgaaaacaaccagttcctcactggctactctttaataacacaattttttattttcctttttccctccctcttcatttaattgatgtgcacaggagagcagataagggtgatgttcggctagtgatcaaaaaaatatttttgtcataaaaatcaacagaagcctctattctagcattttcaggtggtggtttcagagtctttcgggtaattggttttcttggactcagcaaaggcagacttgctttttctggggaagatatatttccagaggttagtgcttgtaaatctgctgttaggtgctggtatatttagtgactttggatctatggaatttgaacttgagaagtccttcctgtggcaaatttaaaaatagagcagcgttgcaacaaacataaccaaaaagaaagtgcttgcctttctgacagttcagcttgagtgcttccagagcagatagatacgtgactctcctgaatcaggcatttgagactttactgacgaaccttttaaataattatcaaaaggtcacttacatatgctgttagatagactaaccattgaaagcatgagaaaaactgctgattttaagtagtctgttgataggaactgctgtggatttaaagaaaagataaatgtcttctgtcacaatactgtcttattgtaaacaaattctatcctagctagagattcactgaacagaaaaggagcatttttagagacagttaatgtatcaggtttaactgattttcataatggtgtttttaaaaaattttccctagctttattattttatgattttctaacttatcagtatcatttgttcacacattaccatctatcttacctaacctgtagaacttccgttcaagtaatatggtgtatgttaaatgactattgttgtcatcattgctgttattgtcataattatattactcatagagttgtttaaaaccttgttgttcaaagtgtcatctgctgactaatacgacattggaaatgagtctcaatcatcaaggtttattagccagctatagtgtacatccggaaaaataggagccacagacacttttgtttttccaaagaggctttatgtgggtatttataaatttccttgaagtgggagagggcaggtagaaagaggggcaggtgagcaggaaggcaaatggctacattcccatgagacttgggttagtgcccagtaaatctacatttacataagattaatgaatgtttgaagagaaaaagagagtaaaggaagaagaaattatgcagatgtctctgggtaggtggaggaatgagtcttgacattgttctgcacctgggaagataagctcatactggtctttatcagtgtgaaatccaacagactttagttttaagagctagacttacattgtagccctgaagttacaattggcattcccttgtttatatgagaggccagcaaaaattttacttttgaatgatctatagggacagtccttttagatgcttgaggccttttaccttcccatggggatctggctaaagaataatgttagtgacagctattcatttggaagagggtgtggcaggacaggcttcattctcctttttgcataagaagtttagggttcctgagattttaaattttttcctttacaaaaaacatcagcatcacctgggagcttgttagacatgcagaatctcaggttctaccccagacctactgaatcagagcctgcattatagaagaaccccaggttattcataggcacattaaatatttaaaagtactaccttaaagggataaaattacttaggtaaaatacctataatagtcctggtcaatgtttgttaaatgttgtcttccctccctaactcagaaaatggattaactcattttctgtctatcttagaaagctgaccttcttttgtttgttatcaccaaacattatcatcataaataacaataataagaagaggtattacatccttactgttataaacattgggaatataagtacaagctatgatccctgaaatagaatatataatctatttaggatggcaggacattttatagaaagtacttaaatatgaggtatctatgtagaaaaactaattctctgtctatgaaaaatagcatcccaacaaaatgactagatagctggaacagtctcacttgaaatacaggcaatttgttgtacatgaaattcactttggaagtttctagtttagacgagttaacttctcagaaagttagatggttatctgtgagatgagcagaaactgagggacagtacaggaggaccacttggccactgattgagagagacttgccacatgtatctgctatcttggacagaaaagaaacaaaacagtttctgtaatgagtcaaaaactgaaagctcttagcctggatgtcctgaagtgcagaaataaagttgagccgttttttcatgtaaactgccataaacgtgagcataaaaagcagtatctttaggtcccctcccctcccctcccttcccttcccttcctctttctcttcctttctccctttcttcctttcttcctttcttcctttctagtacagagccaggcacctagtttaaggttatcagaaatttgggagagccagggttgggtctaggtgagggctgacaaaagaaccgctgcattccaagttctagtccatgaattgataagcctgtatctaccttttacagagctttcaagactgtatgaaattagatgttattccctctcaggctttatcttttaaaagggatggtcttcatgtgtgaattcttccaactcattatattccttaactttacgtaagtcttttccatatccactataaaaaaagtcaaagtatagcaatcagatctacatggaatatttgcggaatctgataacctgctttgagtttttttctctcaaaaagaaaaaaacctgttaataataatcaactattttagcccatttgtctgcatcaatttggtgatttcaatggagaatctacagggatgctcaggtgcctccttattgttatcccctgttcaaatctcatcattgtataggtgtggcttcaattattttctcttaagccaacattgtatttataccaaaggaatctgacttgtttcatttctgctcagtcttccagagctctaaatacttcctcaaatttaattacatcaatttggcatctccctggtgttttcattctgcactttctcttctggatcatttgcaagaatattcgtgtattagaaactcaacaattttttttctgtcaagtaaagtcctgattagccttccattgcttcccttcatctgagctacttccatatatgattaaaatctttctcagtataagaagtaaagttcctatattgaatgcatttctcaccaattcctttactaatctattaaaggattttaatgtattgttaggtaaaatgttctacagaaatcatccaagcttttctctataatgcatgtttctttagatattgtatgatactaaaacttgaaagtggtctggtcttgacattctacaaagtcaaaatttattttttctaatagataaactcttagattgtgaaacatgcacttaccccaagagagaagtctcctcattcttccccttactactcagtggattctaactttacaacacgtaagagatttatactattaaatagctgttaaagactaatttaagaaacttccatatgtctgtaaagtgtttttgcaatgcgtatttaaaacttgaaatttgcataaactaaagagcttttgcacagcaaaagaaactaccatcagagtgaacaggcaacctacaaaatgggagaaaatttttgcaatctgcttatctgacaaagagctaatatccagaatccacaaagagctcaaacaaatttacaagaaaaaaacaaacaaccccatcaaaaaatgggcaaaggacatgaacagacacttctcaaaagaagacatttatgcagccaaaagacacatgaaaaaatgctcatcatcactggccatgagagaaatgcaaatcaaaaccacaatgagataccatctcacaccagttagaatggcaatcattaaaaaatcaggaaacaacaggtgctggagaggatgtggagaaataggaacacttttacactgttggtgggactgtaaactagttcaaccattgtggaagacagtgtggtgattcctcaggggtctagaactagaaataccatttgacccagccatcccattactgggtatatacccaaaggaatataaatcatgctgctgtaaagacgcatccacacatatgtttattgtggcactactcacaatagcaaagacttggaaccaacccaaatgtccaacaatgatagactggattaagaaaatgtggcacatatacaccatggaatacaatgcagccataaaaatgatgagttcatgtcctttgtatggacatggatgaagctggaaaccatcattctcagcaaactatcacaaggacaaaaaaccaaacaccgcatgttctcactcataggtgggaattgaacaatgagaacacttggacacaggaaggggaacatcacacatcagggcctgttgtggggttgggggaggggggagggatagcattaggagatatacctaatgtaaatgatgagttaatgggtgcagcacaccaacatggcacatgtatacatatgtaacaagcctgcacgttgtgcacatgtaccctagaacttaaagtataataaaaatatatacattaaaaaaataaaataaaacttgaaatttgcagactttaaaatagaaattctacttttagaaatgtattctaatgaaataactaaggtaaacattgaaatttagcttaaaaaggctacagtattttttaataaataaacaccatatagtaaattaccaaaatgtatatccactaagtaagttagagtgcagaattttgtttgtttgtttgttttttcttgctgtgctgcccaggctagagttcaatggcgcaatctcggctcactgcaatcaatccctgcctcccaggttcaagcaattctcctgtctcagcctcccgagtagctgggattacaggtctctgccactgagcccggctaatttttgtatttttagaagagacaggtttcaccatcttggccaggctggtctcaaactcctgacctcgtgatccacccacctcagcctcccaaagtgctgggattacaggcgtgagctactgcacccgcccagaatgcaggtttttaataaaatgctatgcagccatgaaaaattacattaaacaatatttaataacatggaaaggggtttaagttattttaagtgaagaaaaaaataaattaaaaatatatgtgatacattttatagagacaactacctacacagaagaagctgaaaggttatacaccaaatattattcatcatgatttctggtagagaaattacaagaaatttctactttaaaatttttgtattttttaatgaattacatttctaaagatagtagaaaaaatgaagctctcttagagctgattcaaaatctttcctattagaacctctgttcatctctgaatcttatttcaattataaggaaagctgtgaatagcttgtaacaacatccaattcaccattgtgagttaattttttaaagtttcttctcccactgtatatggtgaaataggtgaatgtattaaaattgctaaattttgctttttctgaatttagctaatccttcttgagatgtgtgtgtgtgtatatatatatatatatatatatatatatatatatatatatatttgttcttcagcatttttctttattttattctatctccttttgagctaaatggatgacctatctgccagctccattagtaattttatttactgcttcagcctttgaaacaagttaatgcagaagattgaatagtattttagaatttacttcacacagtaatgtgactcaaggcttcattggctattatgtcccctttggcattaaatattttaatctgctaactatgacagatacaggatggccaatttcccagtaaatgtattagcctcctagtaaattaccctttcccaccttataccatgcagcctattaacctataaaatcccttctcttccaatataggcaagatgtcttaactgaagacttaatgttgaacacatcctaaagcttgagaagaccttatttcagagggttgggaaaggaaaactaatcattgcaagcaaactttaagttgctgagactacagatgtcactttggttcatttcctattaccatcgtttgatgaggatatagcccaaaaaccaagctagatgagtattttaataaatgtggactgagattgctttaacagaaaatataagaaatttctgtgtttttagtaatatatcctaggttcaaattaataaatctcttgattattctgtgccttaaacttgtatgaccatctagtcgtaccatttgagcaaataagttaccacctcaggaaaaatgaagtcagcactcaatttatatctataggataattgtgttttgttttgcttttatcttaagcccacactctagtaaacaaaagctatcagaagaaagctttgtaaaatattacagattgtgttgttaaataatactaagaactttcttgcatttcatggaaaagataatgcatattgtgtacttttcattattttaaatgtgtctaggaccaaataaaccaacggtgttctctgtccttctactggtttgggaaaagatttatgtaacaaaccattatcttctagttagaaatcatgaaagatgaggactgttgttcctgtaattaatcaccctatagtagaactctctcacagtgacttaacaaaatacacttatgtatgaatcttaaatatgcagaaggaatactaaagttgaacgggtaggatattttatcttcttttaagctttcatatggttaaataaaacaaaaattaaaagtctataaaacagaatgtatagctttacaaataattataaccaatacccaagttgtggaaaagaatattatcataaattacacacccttatatgctaatttttctttttaatgttaccgcataaacgtccctttctaaacagtataattttatttctttctgaaatttacaaaaacagcagctttatttcttgcttattttagtcaatactacacttgtgagattcatccagattgctatatgtacctataaatcatttattttgttgttccttttttcattatataaatataacacaaatccattctactgtcaaacatttggattgcttctaggaaattacaattaatgctgctattaatattttctcattcctatatgcatcagtgtcttcagattatgtgtctgggagtggaatggttgggtcacagagtgtattaacttttcatttcagaagacaatgctaaacatgtttctaaggtgtccatactgatgtagtctcccagcaacatatgagtatttttgatatttcacatcttcaccacttgatattgtcaatcttttaaattatagccattctggagagaatacagttgtgttttttattcggagttaccaataactaaagagattattctgttttctatatgttcattagatatttgggttttgtcatttgttattagtatatttaagtcacttgcccattcccaagtggttagcttctgtctttgtatattttgtatatctatatctacaaacatatacgtatgttttatctacataaaattatgtatgtacattatatattatatatttaaatataatatatttatcttctggatataaactcattgtcagttaagtattttgcaaatatatttttccatgtgaaggcttatactttcactctcttatggatgtattttgataaacacaggtccttagttttcatgcagtataattatctcctgtttatttttatgtttactactcttatttcctattaaaactttttcatatcccaagcttatgaagatattctacactatcttctaaaaacatatgtttttgctttcacttttaagttactaatccacatggaattggtttacatgaaagatatgagggagaactcaaatttcatttactttcacatgcatgtaattgtcacagcatcatttactgaaaagaatatattttccccacttttgtagcatcaaatcatcatcataataatcataataataaatgtatatttctgtatttttattccatttgtttatccttgattcagtacaacatggttggatcagtctgttttcatactggtataaataactgcccaagactgggtaatttataaaggaaagaggtttaattgactcactgtttagcatggttggggaagcctcgagaaacttacaaatatggtggaaggtgaaggggaagcaaggcaccttcttcacaaggcatcaggcggtagatgtgagtaagtgaaagcaggggaaatgccagatgcttataaaaccatcagatcttgtgaaatcactcactatcatgaggacagcatgggggaagccaccctcatgatacaattacctctacctggtcccactcttgacacgtggaaattatggggatcatggggattacaattcaacatgagattttgggtggggacacagccaaaccatagtcatggtcttaattactttatttttatcagatttgatatgtcccatggagtaattccttccatgttacactttgtttctgtcagagtagattatactgcaataacaaagaattttaaattgcagtgacttataacaacagagctttttgttttgtttttcttgctctctctagttgtccattttgggttgtctggagaatatacttgatttcttctaattctggagcccacactgattgaacagctactctcttgcacatattgctaattaccttagcagaaggaagtagatagagtgtggtgaattattaattggctcttaaatcttctagccaggagtcacaaatgtcactttcacatttcattaacaaaacacgtcacacgaccactcatcacctcaaccaagaggagaaaataaaatattggatagacagcactaatgattaacctaatcttttaaatgagtatataacttattcttgttcctttgatttttctttctttcttttttttttttttgagatagagtctgctctgttgcccaggctggagtccagtggcccattcttggctcactgcaagctccacctcccgggttgatgccattctcctgcctcagcctcccaagtagctgggactacaggcgcccgccaccacgcccagttaattttttgtatttttagtagagacggggtttcaccatgttagccaggatggtctcgatctcctgacctcgtaatccaccctcctcggcctcccaaagtgctgggattacaggcatgagccactgcacccagcctgatttttctatatgaaacttcttattaatttgtgaagttcataaataaatattttaaagattttggttggtattgcattaaatttataggtcagcctaaggttatttgcaagctttaaaatatttggtcttacaatccataaacatgaccatagttagattgagaaatacagatatagatttcggtcttcacacatgtttctttcaattatgatttttggttttctgcatacaggtcttgcataactttttgttacatcatttcttagtatctgatttttttttttttttaagatggagtttcactcttgttgctcaggctggagtgcaatggtgcaatcttggctcaccacaacctccacctcctaggttcaagtgattctcctgcctcagcctccccagtagttgggattacaggcatgtgccaccatgtccggctcccattttgtatttttagtagagatggggtttctccatgttggtcaggctggtctcaaactccgaacctcaggtgatccgtccacctcggcctcccaaagtgctgggattacaggtgtgagacaccgtgcctggctgtatttgatatttttgatattattgaatatattatattttataaaacttcattgcttatatcttttttctagtacatagaattgcaattgattttttaaaatactgacactgtatccagaaactggctaactcacttattaagtattataatttgtctttgcattgtattttctctacattaaattatttccaattcttcctctttctgttctttttctcatatttcatcctcaattagaatctctaggacaatagaaaagtgtgattgtaaacatctttattttatttccaattccaaaggaaagctttcaagtatcattattccattagatgttatagatttttttgtcagatgtcatttatcagctgtgaacattttccattgattcctaattggctaaaattctgattttgtcagatatttttctgcatgtattcaagtgatcatccaatattttagtattttgtaaattcatatgtttaattaaatcaattaaaaatcaattacaacaattgatttttgagtcttacagcaactttgcacttcctgaaaaatatgtatctttcttataatacatttttaaatgtttctagttggtcataacatattatccttttatatactattggatttttttgctaatatttattaaggatttttttgcattcatattcacgaagaatatttctctgtaatttttataatggaaaggttttgctattaaaattattctggcttaaaatatgacttgcctttctccatttttttttttttttttttttttgtttgagacggagtcttgctctgttgcccagcctggagcacagtggcgcaatctccgctcactgcaagctccggttcccgggttgacgccattctcctacctcagcctcccaagtaggtgggactacagtacaggcgcccgccaccacgcccagctaattttttgtattttttagtagagatagggtttcaccttgttagccaggatgctctccatctcctgacctcgtgatctgcccgcctctgtctccaccaaagtgctgggattacaggcgtgagccaccacgcccggccgcctttcttctttgaatgtctaattgaattaaccagtgaaatcatcaccactatgagattttttgtaataaccccttttctatttctgatattgattatcgtttttattattgatctgaatagttagaattttgtcagttttgttggtctcttcaaagtgagctgttccctttctcatctgttttctatttcattgatttctacttttgtcttcactgttttcttttacctgcttacttgctcacttactttcaccttgttaaggtgaaatcttaggactttagttttagattgttctccttttcttatataagcatttaaagctatgaatttgctgctaagcattaccttagcttttcctacaaattgtaatattttatattttccatgtcattcagtttgaaacattttctaattatcttgtaattttgttttaattcatgaattatttagaagtgtgctgtttaatttatagatattgggtgttttcttagatatctactttgatttctactttaattatgttgtggtcagagtgcacacctcgtatgattcttttttaatttattgagacttatttatggcctggcataggatctaatttggtttatgcactatgcacatgtgcaagaatgtatattttccagttgcatatactactctattatactaataagataaagacgtatctttaatgtcttcattgatttttgtctaaatgttctatttattgctgacgtagaggtgttaaatttactacaattatgaaattgtctatctcttaaattctatcaatttatgctccataaattgaggcctattatcaggcacatatacctttataaatgttatgtcttcctgatgaatgcctattttatcatgataaaatttttacaatctctcattatacacattgtcttgaagtctactttaactgataaactatcccctcaattctttttatgtttacagattccatgatatatcattttctttttacttaccttcagtctgtctttatagatctgtatctttatacttgaagtagcttagagtaaaatcttattttattttatccactttggcattctctatcctttaattggaatgcttaggcaagggatatgcaaaataggctcacaggccagccacctaatttagcaaaaatcgttttaaattggacacaaccgtgaccattcatttacatattttctatgactgctttcatgcaaaggtgattagctgagacagacaccatatggcctgcaagatgaaaatatttactctttggccctctaagagaaagtttgccaactgctagtttacatcattagcactcactgtaattactgatgtggataattttagatctaccgttttattattattttgttgttcctctattcccacttctttgttttctttttgattatttgaatatttttattatctcattgtaatttctgtctactggctgacttttttttaatctgttgattttctgcttataaatctctgatttttttttcagtttgttctagagattacaatatgcatatctaagctgtcatggtttactaagagttaatattgtattagttaatataaaacgtagaaatgctgctactttataaatccttttgccccattgaattttaggttatactttattgcttttatatacattgaaaaccccaccagataattattttttctttattaagtgaatttaaagagaaaaataactgttttctgcaattactctaatatttaccctttccaattgttctcaagacatgacggaaggtccagatatcactttggcatcattccctttcctttagccttttgttagccaatgttcggggcagatctggaaggtaataatttttctcaatttttattttacctcccttcctgaatgatatttttagtggatataaaattacggcttgacagttctattctttaaaatgttgtttccctgtcttctgaccttcattttttctgatgagacattctcatcagaaaaatcttattcaaatcactgcattcctgtaagtaatatacgtatcagtttcctctagctgttttgaaggtttttcttcatcttagagttttaggggtttatgatgtgtctatggttttctttggttatactgtttggggtttgctgagcttcttgatgctataaacttaagacttccatcaattcaaaaaaatttaagaccactgtttcctcaacttctgctccagtcactctcttgtttcttgtattgttacattagtaattccttttgatattgtcttataaattatcaaatttggaattacgtcttgtgtgtgtttgataaaatactttgtaacatgtggatcttgtaatactctgaagaatgttgatatttttattttagtaggcatttaactcaagttccgtttgtaagttctgttttaccttctgagaatgatagggattaaatttcagtttagctctcagtaggtttgatgtactgttttggagctgtccgtacatgcatagctcatggtgatcctgaaaattgtacaggttcattcacgggattagggaatcttttcttttccttttttttttttttttttttttctgagacagagtctcgctctgtcgcccaggctggagtgcagtggcgctgatcttggctcactgcaacctctgcctcctgggttcaagctgttctcctgcctcagccttccaagcagctgggattacaggcgtgtgccaccacgcccggctaattttttgtatttttaggagagacggggtttcatcgtgttagccacgacggtctccatctcctgacctcttgatccacccgccttggcctcccaaggtgctgggattataggcatgagccaccactcttggccgggattagggaatcttcttatcagactttctctatgctgggatttcccctcactctccagccttctggagcttttctttttggttctctagacagaaacatgagagttgtattggagttttagccaaagagaccattaccaccatctatatgatgctttacaactgggcccactttggggagcaatccacaggagagcatttcaaacacacacatgcacacaacaggaaaatcaaccctgtaaaattgcttctccaagtctgtactctcctccaaagttgacatgctttttctgcttttccaattaaagtcaggtagtcatttttgcattttgtcagcatattcagttctgatccatgagacatatggtctctagtgagcttacatcaccatgccaaaactaaaactgctattttctaatggttctagactccgatattttgtatttttttctagggattttgtatatgtgtttatttcagaggttggagtataatttttctttttgaaaggactctttaggtgcactaaaattttttatatatctctgaaaaattaaacctttatctttatgaagtgactatttctagcctcattatttttttccttgaagtctatcttctctgatattaatatagcttctctgggcacattttcctttttttccgtttagcctattttctttgatatttgttaaaaaaaattctgttcaaaaatctattttctctgatagttgataagtattttaaaaatatgctgagtgatttttttgcactaaaatcaattttctttgacattaatatgtttttatgcatgaagtctattttctctgatattggttatttattcatttattttgctgccttaaattctattttctctatactagcagtatactggtatttaatatgcttaatatttgcatggtatatattttgtaatccttttatcttgaaaattctttatcctcatgttttaaatatagtttttaagtagtatggtttttatcttttaaaaaatgagtctgacaaactttgctatatgactcattttttaatacatttatatttggtggaattactggcatggctgaattcaaatttaacatgttggcatacactttatactctatatttgtcctaccaaatatatgtttattttattttttgcttccttttggttgatcattgttattgttgtacattgttttccacagtaagtttggaaatgaagcatatctttttttttttcagtgattaccctagaagtgacaacatgaattattcaccaagatctaatgatgaacaatacttttctttttttttttttttttttttttttttgaggcggagtcttgctctgtcacccaggctggagtgcagtggcgcccatcttggctcactgcaacctctgcctcctgggttcacaccattctcctgcttcagcctcccgagtacctgggactacaggtgaccgccaccacacccggctaattttttgtatttttagtagagacagggtttcaccttgtgagccaggatggtgtcaatctcctgacctcgtgatccacctgcctcagcctcccaaagtgctgggattacaggcgtgagccactgcgcccggccatgatgaataatacttttactctccttttgaacaataaaaggtccttcaatcaattaatcctatgttttgccaagctgaattataggctatttttgtcatatattttattcaagttataatttaaatttggcaaaacattattattattttattgtgtcactgctcatttacctactttttgttactcctcatttttttcccacacagagtcatttttcttctgtctgaaaacacttcacaattttcctttgtgcttgtctcctggtggtgagttttcttattttctttctgaaactgttagtcctccatctggaagaatattttcttgagatatgtaaatataaattggaaattattttctttcaacagattgaatatattataaaacatagttcagcttcccattgtttttgttaataagtagttgccttttttcccctgaatacagatattttatctttgatttagctttatacagtatatcagtgatatgtcaaaatagggatacatttttatttatccaccttgaaatttttttagactctttaaatctattatctactatcagtgtggggtaaatcttagtcataatttttaaaaaaaataattctttttgcctaattctctctgttctccttctagagattccaatggcaaatatgccagaacttctcctatttttaatagctgttactctttcttttgcattccagtcctttgtatctttgcattttttttctggagaataccatgcagcctatttcccagtcctctgtttacctgtatataatattctatttagcccattcactgagttatcattttcagctatttttacccttctaggatttctatttggtccttttaaaaaatgtagtaaatgtagtatatcactttctataaattacagtttccatattttgtctttttatctcattaacagaataagtataggcttcttccttctttcttcattgtttccttcctgtcttcctcctttcttcatttttttcagtctctcactgacactgttaatatctggtgtccctgttcttctactttttggttattttttctctgctattttttgttcctatgaatttagttttactgcatacttggctctctgattatatgttggatattagttaaataacaattgtagaaataatttcagatctgggatgataattccatttaagggattttcatggtgttctgggcattattaacacatgactgtcttagtccaagttcagggtgtggaaattttcatgatttctcaaatgacttgaaaaggggttctagtcagcgtagtctggtttcattttgcttcacttttattcttacatgtagttcttcaaggtcccagccaaaaaacaaaacaaaacaaagttgtggtgatcttccctttggcagttccttgtttagacttttgcttcaaattcttgagatgttgccaaaagttctgttcatcctctcaactgcttcttccagaactgcaaatgccattagattaaggttgctaaatgttaaaaaaacagaatgcccagttacgtttacacttaagataaaccttaaataagtgtaagtatgagaatgtcccatgcaatatttgggacatacttaatacttaaaaataatcactgttacatgaaattcaagtgtaactgtgcattccgtattttatctggtacctcaggccaaaagtgaccaaaatgactggactacctcctgatttccattttaacctagatcttagcccaggcccgcttcactgttcggttagcattttgatgcttttaaggtgatattttaagcaatattttttccagctattttagttctcttcatgagaagtttagtccaaattacctagtccaccatcaacataatcaaaaggctaatattccattttcttggtggctttaacatcaaatataccaaaaattacatcaagaagcttaaagatagctccctgacactgaccctggaaataacttttggacagtacagcaaacaagagcacaaataaacaagtggaactatatcaaactaaatagcttctgcacagaaataaaaaagagcaataaaatgaaaatgcaacctatgaaagaaaaatatttgcaaactaggcatctgataaggggctaatatccaaaatatacaaggaattcacgtaactcacagcaaaaataaaaaacaaacaaaagcaaaagcataagcaaccaaatagacattttcccaaaaaggcataaaagtggccaccaggtgtatggaaaggtgctcaacgacactgataatcagggagatgcaaatcagaaccacaatgagatgatatctcacacctgtaaggatgaatattatacaaaaaatgaaagattataagtgttggcaagggtgagcagaaaagtgagcccttccacactgttaatgggaatggaaatcagtatagccattatggaaaagaatatggaagttcatcaaaaaattaaaaatagaactaccatatgatccggtaatccctcttttggtatatatccaaagaaattgaaatcagtatcgcgaagagatttctgtacccctatgtttattgcaactttattcacaacagccaagatatggaaacaacctatgtatctgtgaatgcatataaggaaattatgatatatgtgtacatatatcatatatatatacacacagtgaaatatttagccttaataaaggagcttctgctattttcaacaacatgaatgaacttggaggacattaagctgagtgaatgaagacatatacagaaagcaaaatactgcatgatccacttatatgtgaaatacaaaaatgtcaaatacatagaagccaaagagtagaaagctggttatcaggggcagaaaggtgggggaaatagaggaacattggtcaaagggtacaaagttgcagttatataagatgaataggtctagcgatctaactttcagcatgatgactataattaataatactcttttataccaaaaatttctgagagaatagatttcaggtgctcccagcaggaaaaccaatggtaactatctgaagagaaagatctgttaattcacttgactgtagtaatcaattcattatgtatatcaaaatatcatgctgtacaccttaaatatatacaattttattaaaaagtaaaaaagtgttagcatttaaaataatacaactgcaattttttttcattttcatagtcatatctttgtggctactaggtgcttattaagcattgctttcatgacttgctcaattcagaactaagcatctgaaagaacatacattctctattttttgttgaattgaacaacgtgctttatatgtgtgcatattgggaaaaggcacatatgctacaaaatggggaaaaacaatatccatcattatttctagcatatcaattttctataagttctctgaaatacaggtgacaccataaacaaggcccaataaagttgttgactaaatgactactataaataaatgaccattatcaatttcccatgtatcattcacacaggtgatgataatggtgtcatcattaactattccatacatgctctgatatgataacacaaaaattggtatataccatgttcagtctctggtcaaaaacattgtgaatatattaagcatgcttcagtgagggtttgttaaaatgatgacaaagacagaataatgagtgaattttaccatttccaagggaattttctgcaacggtaggatttttgtttctctcaatatcccatctgattgatcacaatgtctaagtgaagtaacagacaggacttcgtcatttctggctgctcacacataagtatactcccacaactggagttcctatatttatctccttacttggttttcagaattgttgagctcctccttttcctgattatgcatgaaatgttcttagtctttctttttcataagacactaagccttacaatattctgattatctgattctgattaaaaatattttttacatcacttttttcctgttaccaattttgagttggttttatatgtttcatttatttctggtgattaaattcttgtagaaatagtcattagatataacagttcactagtaattgagtctgtggaggtatttccagtatatatatttaaaataattatgaccttcaaggacaatcatactccttacccttgaaaatgacatggtcagtgatactggaatgccagagaactgtgaatagaaggtgtaaaatgagagaataagcactggggaaaactgggatatggataagcacatgccatcatttggaaaaggctgcaggtacatttggacaaagcagctaggtttctgggcttgacctcccagatcctgctgtcagacatgaagccttcagttatgcttgtaagagccatctctccggttgccaactccaatcttttacaaaaagctgaagcacttctactttctatatgaataatggttttaatttaaatgtctttctttcctactcttgccaagattttgttcatattatcattttcttttggggaaatggcaaaaaataacttatactctttaaagaggtatattgggtattggaaatctttgacacttttctgggattcactgatggcctgcaggactctagatgaaaaatttaagtagtacttttgtcttataataactaggtatcacatattgcataaattcctacatggaaataaaggccaaaatgccctgatattgatggtttctacttcattatttttcacaccttgtgggtgtgcacaagtatgtttgtgtgtactgatttgtgtctatttcattattggaataagatagataaatattttaaatatatgacaaattcatcaatgtttatggtacacctgtcagcaagagtctgaaaaggagttgaaactgctgtgggggaaatgactggttatgactaaaacctctttcagggtagagaaaacatccaatttcacattcacagttttaattagtatctattcaaatctcactaaataattctatcagtctctcttggagctgctgatccaaatccaaatgtctttttatatttcaccctaattttagaaaagtcactaaaaaacaacatggtcttcactcttcacatctgttccataaatcagtaaatggcatcatcatctacctatgtgagcaaaactaaggattcatctgtgacaactccttttccttcaggttcttatatccaacccaaatatctctcatatctatgttcatttttcctttgcaccagaacctccctacaaatattagttattacctatacaaatcatctccttctagctattcttcttctccttgcagccaatcagacccttctccactctgtttctattctgcagtgactctgatacttttaacacaaatctggtcttgctccctttcttaaaaataaggacaaaaggacttgacatggctacaaggccaggcatgatctggtttttacccacccctcccaccctaacctacaccatttttttcctcacttgttctcaatgaggcacaatattgcctccttccagaggacattttgcaatgttgcagcttttttaaattgtatcaactctgggttgggtatttgcctttagcatctagtgagcagaggtcagggatgctgctaaacatcctacaatacacaggaacaccccccacacccacctccaattagcagctgagattctgcttcatggagaatttggtgtacaacattgagtttctttcagtttcttatgccaccatgcaccccccgctcgggtatcacgacagacttttatacatgctcatctctgggtctgaaatgttctttcctcatttactgggttagcatgtactcatcttttagaacacagtttaaaccaccaattcctcagtgatcctcttctaccctcttgaccaaatgaacatctctccatcccacgccacccccttttaagctcttataatactacatagtaattcatttttagtgtttctcttatgcaattttactttcactgaaataatatttgggaagtgtctgtctccacttctacatcataatctatttctgttcatcattgtatcctagtgcttaatctgacgctcaacacacaataggcacgaaataaagacaagtgggaagaatggagagaggacgggattgcatgactcacagggatttctcagaaatggtggttagagaaaaaagccataatatgcttttcatctttgttaaaagtgtaaactcaacaatgagaattactccttaatatttctactttttattaagctggtcataataaaaactccttgtgttccatcttctaagcaaaacacagcaggaagattttgggttttgtagtcagattattcaggttttgaatttggagatagaaacgtgagcgaattttataactttttgagtcttggttttcttatctgtaaaacagtaacctacctcatggcactgttgtcataattgaattgcctacaaagcacttgattcataatagttgtacaataaatactttagtagctattattccactgataccaaagctaaacgagtaagaaaatttgtctctgtatcttgcaatgtatggttattgcagaaggtgttgcaacacaggtatcaagagttcacagctacaccattgctattgttttatcatgacttttttgtacttttatcatttgggaatctacagctttatgtcctagcctatttgcaaagctaaatggatattagtttatgaattcattattccaaaaacttcattatattctcggtcttgatctataatggagtgtggtatgaactgaatgtgtcctccaaaattcatacgttgaagtctaatccctaatgtgatagtatttggaggtggggcctttgaaagggcatgaggttggagccctcataaataggattcatgcgtctataaaaaaagaaatgagagagcttgcctgctctctctctctctccctctctctctgactctcttttctcggccatgtgagaaactagcaagagcacagccatttgtaaaccagtaagtggaccctcttgagacattggatctaccaacaccttgatcttaaacttcccagcctgtagaactgtgggaaataaatttttgttgtttaagccagccagcctaaggtaatttgttacaacagcccaaactaagacaaggtgactctttaaaaaaataaaaataaaaactttaaactcaagaaaaagaaaataccagtaacatcactacaagttaaacattaacaagttataaaacagagttttacaggaattttatctttttatctaaaatcaagaggagtagaatcctgaaatttatcaatgtacttcatctttaaaattctttttgttcctttgacatacaatgcacaaatgtactgagagggcaagacaatgggcaaacatactggaaaaactgtatttgtgaatttgttacatctaacaattattattaaatgtttaccgtgtgccagacactatacttagtaccttacatatattgtcttaattaatgctcacaggaaagacatatcacaggactatttctcacatttttatcggatacattaataaacttgcccaacatcacttggctagtacacaataaaaccaagttctatgtaaagtgattgggtaagaaggatctaaccaggggaataaaggagaattacagtttgcaaagatgagaccagggttggatgatactcagtatcacaagagaggaagttaaaggactctgatgagaggagacattcaaaacaggaagcaaggagattgtggacctggatgaacagactaaataagcaaaggaaaatgctgcagggctttaaaaactttacctaatggaaacttttgagaaatctttagcatgagagtgaccataggatttatgagaatagggatttttacacccatttttttgttgtttgcatgatctcaaatttcacattatcctacatgatttgaattgctctatattgtcaataacctttagtcaggttggcaatatacatcgtgacgatggtttgtgagggggagatcaaagataagggatcgagtaccacatatgagatggctcagagaagagagaagataacaggtgagaggtaacagctaagtatgattagaagttcaatgaatagaactaggagtcagaaattactatgaaaacctaaggcctggagttttgtaaaaatttatacacacgtgcatacatattagcaaagacataggacattgtgcatctcacagaatgttggtgctagaacaggtcaattttactgaaatctcattgttcaaggaaaacttcagctaacagcttgactttgttttcatatataaggtaactgacaaatttctcttatttacattctctttaatccttattttaatcatataaatgtaaacattattaccctcatttcaaaaagaagaaactgagctcagataggttaagccaactggctgatgttcacacacctaagcagatagcccagctgagatttctaactcccaagtccagctttacttttccagcagcacgtttatctcctttaagtaatgctaagtcctcctctatcctttactctttgagagcctataatacaatcatgtgaggaaaattttaaaagaaagccaccaaaagcacaagcaattttactatcctcgattactcaatatttaagactacattaagtgatgtcaggtagataagagccttgcccagtggtctgagcatagaatatactcagttttatttttgtggttgtcattggattatgctaatatgtacagatcaaaggtaattttaggatctcttttagtttattgattgtaaaatagtctaataactatatttattattttataaaataatacttttaagtatataaatattttgttctaagaagtttgaagcatttcactggaaatatctttatactatttgttcaataaaaccaattacagttcatcctaactccaacatagcataactcctattaatgatcacttttattgcatttcaggaacattaaaataatttttcgtgaaaatatgtaatataagcctgacccacacattttaagggaggatggcttcatgaatacatcatcaattcctattgctttttatgtgtcagtgtagaactgtcactgccaaagaacagcaggtgaccacatagcactcaacttcccttagtgttctatagactgtagtatctttgtaattgcaaagttaataattatattaaataatgcagtatagaataaccactgcttttttctttcaaatctctatcattagtaaatatcagtcatacatacattagtcaccacagctgtttcagattggagcactgttttacaaaaagagaaacaaatcaaatgaaatagccatttctcctttattttgcaaattacagaagaattaaaagtaattctttttatcaaagacttctttttctctatgaatacaggcataccaaatcctgatttggttttctttgctgaaaatatgctgtcattttgcaattcacttaaaaagattaaaagaaaaagttgttccattacagaaaaaaagattttttaaagatataattacataatctctttgctagttgtttcatatgagaaagaaaaataaatcttggggcccccaaaatcactaaaccaaagagaaaagtcaagctgggaaccatgttgggcaaaccctcctccgattctattcctacataagatagttacaaagataaaaggtctacatacccccctcacaatttgcccacaaggaaattccttgtggacaaaggacagacagaactaagtcatccctctgctcaaatgagacaaatgcacatctgattgcttcctttgccctattgtttcacgaagccagactaagacataagtgactattccaataaattgtgtattcagtgaaaggataatcagaaactcaaaagaatgtctcttatctacctatgacatggaagccacctccccactttgagttatcccgcttttccagaccaaaccaatgtacatcttatatatattgattgatgtctcatgtctcccgaaaatgtataaaaccaagctgtacctccaccaccttgggcacatgttgtcaggacctcctgaggctgtgtcaagggcacctccttaaccttggcaaaacaaactttctccattgactgagacctgtcgcagatattttgggttcacaatactctcctttataggaataatcgatacagttttatgcgcttataataaggaaaagacttcgccaaaagttgtctacttggtgctatgttcatatttccagaactgaaaagcagagttaaataatgagcaaagtccttattgctgtgcctgtgacatactacagatcttgcctctagccaggacccataatgagcagatgtacaatggccagactaccaggaaaggcttcagtgtcatacaggtttcagcagggctatggtctagatggctactcttccctgtttacctcatgggcccgcttcatccagattacaattctcttcccctagcttctccaagcctctctgcaaatagaaagtgatgatgccattgggatttgattgccccattgcttaactactggttggcaaataaggagtgctagatcatttgttaagtgagtcgacaagtgagtcacatgtgaatgctgaggtcttctctttctgattttgaggggacttgaaaagcacggactctttcattctcagtaacctacttatgctatcatatcctgacaaagttaccaaaagtgccttttccttgaaggacataaaaggtgaggaagggacaaggaagagaactaacatataatactgagcttgaattatttgagctaggcaatttatggatgctaattattcgacgtttacaataaattagtgggggaagggttatttgtattttattttttcaagtgaaagaaatgagttgctcttcagttaaggcacttgctcaagtcataaagctagtaaaagtcagaaatagcattagaacctatgtatctttggctatttccactgggcagctctgcctttcgtatgcatatacaggaacgaaaaataccattctaccttccttccctttgggaaaatgcattccaagtttcaaattactgagtcataaaacaataattgaaatatttcacttccttataccaggagcttcttggagtaatgacattgtaaaaaagaaagacacaatctgtaaatatttattatctaaagccaataaaattgacagcacctataaaacaatcacttcaccaatttgttgttaggtactacttgatccaatggagatactgagtttttactgttctagcaccattttacgttctgggaatacaaaggatacataagagatggagagagaaataagtaaaatgtgtaggtaacaatgagacagatgtcaagtaatagctaatttatataaaatgatgtgggaactgagagatgagggccatggggctcaagaagagaggccattagcaatgtcagggaagctgcacttagaagtaatacgtgagacggatcttaattaatattccataaagggaaggataggggaaatataattaaacagacttttaccgaacatcaaatgaagtagggaaaacctgaggcagagggtgaggaaaactcacagcaggttgaaggatggcaggttgcctgctgcagctagcatggagtcgcgcctgaggttgctgcaattcattctccagatctctgttttagcgacataaactcaggaaagtttttcagagccccaagaatatgtcaggtctctcaggtataggctttccgagctctgagctccttcctctcattgcactgatctctccttgtgaataaacattttcattatttgattgtttgctccctctcccacatgggcagaaaacattaggagaaaaggagatctatctggtgttgcttttcattatatcccagcacctagtattgtatctgacatattagcagccactgaaaagaaaaaaaggaaatgaggtaaataaatgttgaaagaaatcctgaggtcaggacgagtaggttgaaaccagaacgctaacggattcatagacattgttctgtggagagtgggaaacactaaattttatttattgactttcagtgggaggaaaacataatcggggctgtttttaaaagttagctttggctgcaatgtggaggactggtaactaagagtagagcctgcaggcattaaatgaatgtttcagtattctctccaagagataatgaagtcccaaaatggaacagtgataggacttggagaaatgaagaaagacacgagttgcacatattcaaatgcccaggatttggtgactgatgggggagtggcaaagagaggaatcagggatgattatcactagtgtcctagatcatgacaataaatataaaactgcttgaaatttaaagaagagaaactggttcttctcaacaggaacattttgatggtaagtctgtgcccagattgaaatgcagcttagcttacataattgaaataatcacgtctgaagtattcaaacaattcaaaatcaaacgcaaaagcaattttcatgaattgagtgggcgtatttatttttgagttgaatgaaaatgtttttgactagttgacacatggtaagaaaaataataacagaaccaagtatatgcagtacaatgtgaatctccttcccatcgctgtctccttgtcctcttcatgctccaagaggcaacccctgctactaggttcctgtgactcctgagtaggagtctggctaatcatccaaaaatgtcaaaagagaaaccaaggtgaatttctttcccaagctgagatttgaaataaactgctagaagttgtcactgaatgtggatattagcaaataactttaagctacagaaacatcacagatttctgctttactacttttctgaatttgtaaaacacaaagagagggagagaaaaagagaggtggagaggtgggagggagtgggctagggtgagggcaagagcagggagcggggagaagaggatggtagggggagggggagagagaggaagtgggagaaaagggacaaagggaaggggagggggtagggagaaagaggggaagggggagggagggagggaggagtggggaggggtttaggtggcttttgaagtctaaagttcatttttcaatatcactatcactcaatattatgaacagggaactcacaggcagttgacagacacaggcaaggaatcatatgattagactaatcagtggaaggtgcaatgacagaggatggcatgggagcctatgaagaaagagatgatgtttctgtatattatacattctccagaaactaagagctccaatagtctatcgagacttcatttccctggcctggcgaggtggatcacagatgtaattccagcaatttgggggccaaggcaggagaattgcttgagcccaggagtttaagaccagcctgggcaacatagtgagaccctgtctctgtgaaaaataagataattagctgggcatggtggtacatgcctgtagtcctagctattcaggaggctgaggcaggaggatcatttaagcccaggaagtagagactgcggtgaatcattattgcatctctgcactctagcctgcgtgacagagcaagtctctgtctcggggaaaaaataaaataaaaataaacgagagagagaggaaaatttcatttcccttaacagcgaagggcttcactaaaaacaaatttatcatcctgccattttactaagatattgttttcacacatccccctttcaggtcattgccactcaaccatgttcaatctttaccctcctcatctctgagctggcatccatccatcttggttgatgattttttccagctcagagactcagtgccccagcacagcagttctccaagttacaataataaacttcatttgctcttctgactactctgggtcctgaaaatgttataactgacacagttgcagagccatccattggaacaactacactaaaatatagagattgtgttcaaacatgtatacttcacatttacagtaattactatggctttactttcatttgcttctctcagttttccttcatcttgcaacaagacaatcaagaaaaagcaggtagtaggtagcttctaacagaagaacagacaaaagagagcataaagaagatattagccaagaagtgatgcttgacatttttttcaaatagaaatctattaaggaccttaaaaaatcatctattatagccaaactggtgcctaactgaagtagtagctgagagtgcttcattgaaaatcaattagagtccaacctgattgtagacagtgtcccttcaacaaaactgacaagcattctatctctactttgataacatttgtatccaaaatgagaaaacactagagaaatatgaaaataaggcaatttcaatgtatgagttatatcccttaagttcatggatgacattaactaagttctgacaccaatacccctagggtgtctttatttcactcccccttctggaaatgattgaataatttataaaggatatatcttgggggtggccacttctacttcctgagctgcatacagaacataacatttttagagctcagaattgggttcaccaccttccattgcacagttaaagagactgcagtccaagaagggtaaggggtttgcctgctgtcacaaagctagggagcaatagaaccaaagttcaaatccagcaatgctggctgcaactctggtatcttctttgcattcttctgcttgtaccaaatcagatgttagcagaaacgcatggaatcctaggaatagtaaacaaagagaaactgataacaggacaatttacatacatggggcagaatgacaaaggaaaccaacctgggaagcgaagtctgccagggctggcagcagagaaagcctttgcttcctatctctacatcctaaaggaatgaggaggaggaagagagaagtaactgaaatccagaaagtactctgactatagcaaaggatctgcaggagctgtggccttggaaaggaacatgccctctgataaactgtggctttgtcaggaagaagctagagaataaaagctagacatcattttgctcctggcctctaatcacctcctagtgcctctcattagccttgcccaaccagaagccagagaacaaaggaggctgccccatcgatgttctcctaggaccataggaggagagaaaggggatgtggagggacaaatggaaaatattcagccaatatttcttagctgcgccagccttttgctttgcaatttagtcttccttaccctcctctattttctttcattgggacaaacattatcaaggttaataagagataatggcccatgtaaaaagagtattgtattcttttatggactttatctaaaatttactcaaatataacagaatcctgtagatgaagcataatatgcaacagatatactttgcaatatttaaaaatgattaatctcaaaagtaatcatctcagtactatgactcattagctggaagaaaacagtaataacatgttttgtgcacagaacaattttaattaataagcaggacatatttattcaaaaattataataagacattattattctcagaacatgaactttgatggtaggtgttagcatcctgttgggtcccagagaatgcacttctggatattaaacatgatggctttgagacctcaaatatatcagcttgtacagtcagctattatctacactgacaattgtttatggctacaaatcacccacgcttgatgtgatatctgaaagtacctcagtaagatattatgagcaatatcaggagtgggtggtgtaaaagtcatttcagtaataaaacagtattcaaagagttgattcaaaaggcagagccattactaataaaaataatataggtagatatttgttaaatgttttctttcttttgaagggcaatactatgaaaggagagtgagcatagggaagttgtctgcaacctctgagccacacacctttctttggtctaccacatatctgtgcagccattaagaatgactctcatctcttgcctttccaaaatgaggtgtaagagaagtcattctggtatagacaggagatatgttaccaaaacagtccaatggacccttttagggatacttcagttagaagttttagctctgtgtgggttcagtgtctctccacattacccctgagacctaaatcccacagaaaatcttaaaggcaatagatgctagttttccttatacctttcaaaaatatgatttgttttgttttgttttgttttgttttgttttgacagagtctcgctctgtcgcccaggctggagtgcagtggtgcaatctcagctcactgcaacctctgcctcccgggttcaagcgattctcctacttcagccttcccagtagatgggattacaggcacatgccaccacgcacagctaatttttttatttttagtagagtcggggtttcatcatgttggccaagatggtcttgatctcttgacctcgtgatccacccacctcggcctcccaaggtgctgggattacaggcgtgagccaccgcacccagccgacaaaatatgaatttttaaagaccaaacacatcagaacaaaccagctaacttgacttttaaaaaccacttgatttcacacaggtctcagatggagcaaaagtaaaaaaaaaaaaattaaaaaataaagacatcccacttgaattctagacaaaattttatattatctaatggaaatgttttttaaaccacataaactgatgagacatatcctttatcctctgaaagaaagaagaaaaaaacaatatttactagctgaacaaaatgccttgagtgaaatatctgtgagcatacatttttaatttcctaagatgaaaacagttttgagcaaggagctctcaaaaaaatgtcctgatgttctcctaatacaccaagaaataaaatctgtcaaagtgctgagattcttataggttttggtacatgttcccagttgatttgatctggctccagatgaaacatattatttaagcaagatagtaatcaaggtaactaacaattttaaaaattacttcaaagcatatactaaggcttgactagtgtgtatttattctctttccattatttctagacggagaaacaatttcattatattttaagttgtatcgaagcatttgttctggaactttctgatgcattagcagattctacctttaatatagtcatatgtgtaggtgtattatcatgcctgctagaccagaagaagtgaaagcctgaattggttatcgcattcccttttggagattaaaaaatagcattacaactatctgtgttgcatttcaagctaaacccatactttcatataaattgtttcacttggtctacataataatcctgtgaggaaaacagggcagcaattactgccccatttcatggatgaggaaattggcttagaagagttaagtggcttactcaaaggcacatggctgagcagttatggacctctgactcataactaagcccagttcaagaaaacacgtatttattcagtgttttaaaattatcaccctaagtcttttgggttcaaggtagtatacatatggcagactaatgaacaaaaagaaaagtaacatttatacagtatttattatacaagagtccctctcataagaactttatagataatagggtcattatagatttatctcatttaaccccatagcgaccttgttaacagtgagataaatctgtaatgacccataacaaccttgttatgcagttaaataagataaatctataatgaccctatgtcattgtcacgtcacagatgaagccgccgaggcacaatgcagatgattaatttgtatagaatcactgacgcattttttaaagaaattaaacaattaattagtgtgtattcatactagttgtacatatttatgaggcaattttgattttagagtccatgttcttaaccactatacatatttgcctccagagattccaaaacttacggacatcttttcattatgctacacagtctcccatgagcagagtatgaaaaaaatccagatatgaggccgggagtggtggcttatgcctgtaatctcagcactatgaggggttggggcaggtggatcacttgaggtcaggagttcaagaccagcctagccaacaaggtgaaaccccgtctctactaaaaatacaaaaaatagctgggtgtgggggcacgtgcctgtaatcccatctactagggaggctgaagcaggagaatcgcttaaacccgggaggcggaggttacagtgagccaagatcgcaccactgcactccagcctggttgacagaggagactctgtcttaaaaaaaaaaaaaaatctgaatatgaatctaagcaaacatatacacacaaacaggcatacatacctagacaaactatatgtctatctctacatctacctatctatacatacaccttatgctgagggtcttgaatatgattgataatcacattctgtgtggctaattgcatttaggccaggactcaaaaaaaaaaacaaaacatgaaataaaccaaaataacctagatgagtgagaaattctaagtttgaattttaactggggaggaaaaaagataaagaaaacttcacagattggaggccacttatctccacatttaactttcaaaacctttctcaaaatatctttgtatttaaaagaatccatcagtctttgcaaagagaggagagaaaatagacttgaggaagatgtttccttctgtgtgctgtgtgactcaggacacatgcttcttctgtgcaatgctttaccatcatctgccaaagacgtgtgtgcaaatatcagtcttgcaaacagacaatatttgcactacattgaggctaacctgccatctgcttatcagatgttcggagtccaaattgtacagttttccttgtgtttcccctaatgaaaaatggaatgctggggctctgattacaagtgtctgtgcacaggactaatactacatccctaggtagagtaatggaaacagtgcatctaggggaaatggcttatatattgacattgtttaaagaaaacagaattattttctgtggctcaggttcacatgaaatataaacctcctagttcactaaagtgtgatatatttttctcaaaatttggagaaccactgatgttctggacaactgtatttcagtgttaggcctagccgaatatatcaactaaaaatgcaatcacagtgaaaaattctaatgatatgcattatttctgaataagcaaatgccagaagcacaatcccaacatattatgaatgatgtgattgactaccagggttgctcgcagcccatagcttcaggtaacacagctgtctcctcccattaatgagaaaagagatagcattttctgtttaaaattaataactgtaacactccaggattataggaaaaattctaagtgtttcacacaaagtgcttcacaaaattttactgaagttcaacaaaatcattatataacaaatacatatgagaaattcttctttatggcttattctattgaattgcctattcatttttgccttcccagaatccacaattttcagcaagatgaatatgagcagaaataaaaatgccctttctatttaataccccctgctttcaattaaaagaaaactggttagtcatttagtatcttagaatatttcttacttataatgaattaggcattaattatattcttctatataaccaaaacaattttttagcaatggacaacactattattttctaattcatgttactttttttaagcatgcctttgggcattggatcactatcagcaatgtgcagagaatatcatcatcctttgaaaagctgtactactgatgtactttacagataaatagtaaaaatgtttaatgtacacctaaaacacaattgaaataaatgccatttcaggaatttgaaagtgtgttgaggttaccaagattatctgtgatccttttcaaacagcaataatttactcaaaaggctgtcatgtctgcttacaagactgtgcagatagttgacatagatgaaattagtattaatatattcattttaatttctacccatttactgtcttactaagggtaatttaactcagaaatgccgtcataatagggtgataatctgataatccggggtgcagtggaggcagggaagaaaggaagaaaaaaggaaaaacaatgacaataaatggcacaggcaagaagaaagcaataatgtaataattactaccatgttttgttcaattatcaccgaaaaatccagaaagatatgaaaggtgagcaaaggttctaccatgtttttgtaaagaaataaaagctcactgaaatattagggagaaatggaatcaaaagtaccaatgaaaaaagcaaaaataagataatttaaaaagaaattagaataagaaaaaactaggaaataacgttctttacatgtgaataatttctttttggttgagttgtaaatcacatatctgttattcaaaaatatttcctgattcatttgaaaagaaaacatattgaaaagggatctaaacaaaggttgtttttttttcccctctttaaatgttgctacctcaaacaagctgtaatctgagtattaaagtacaaaacacttaggaaatataattttccatgattactttgagcttcctgtaagtgtaacagtttttttactacagttttcctctctaaagacagaaatgcaccgtatgggcgcaaggatgctcatgccatagcctatgctcaaaagaggattcttagtctacattccagattcagctggagtctatattaactgcatccattcttttaatgttggccatcttgtatgggttggatgtcccaagaagccacttaactatgggtgtgattgtctattcaagaacctagaaaaaatggtaaactggttacataacaaataacacatcttgatctaagttgagaggactggagtcttctagctatattatttgaaaaaatgcaatcatgatttagtgacaaattgaatagcaacttcattaaccagaatttgactgtaaacccatgcaccgtcctagccagtatctcttttctccggaagagaggcatgggaggaggggagagaaaaaggtgagctatactactttagagtcttatgctagttctgtgaggtaaatgtaactactatttcctttatttaacaaacaaaaaatgaggctcaaaaatttaaacaacttgtgccaaagtcacagaggtaagaaatactagggcaggaattgctcccatgtctgtgtacctttaaaattcactttgcagctgcacagctgataagtctgctcagaagatttaaattataagaggaaaaaatgccttgcatccctggcactgtgcctagttctttccccaaactgaaaatgatacttgcaattttttgagccctcaccatgtatctggatcatttcaattaatcttgacaatgctggtcaagggactattattagtctcattttgaagatgaagcttagagaggtaaaataacttgccccatatcctacagctggtgggagacagagatggcattctcaccagctctctctaaactccaaagcctgtgctcttcccatttattccattctgctttctctccaggagtcttcataataactctgagttcagcagctgttttcaatgaggatataggctcaaagcaaatacaacataaccggtacatggttagatttctaagcctcttgccattccgccttgtggacaaggacatcaaatacaatgaaaaatgggtgccccgcaaatcaatacatctgttctttaatacctgtgatcacagctgtgaaataggcttaatacacagcctgaaaatattgttgtgaaaataactgtgtgtttggctgttaagtaaagttcagctggacacatgatctagtaagaggtgctaggctgctgcatgcaaaggaattccattagaaaagacagagaggtatgggaggaaaccgagcacaaagcagtgtgtccattgatgagagaagtcactcccacttcgcccacagatggtggcattaataaagatatcttgtacaatccaatgatgtgaatctcaatcttcagcatggataagaatcactggggagcttgttaagaatacagttttagtgtcatctcacctaagattctgattcaattaagtctggggtggtgcccaggaacctgaattttataaacatcccagctggttttttaattattattactattggtttctactttattctaggtttagtggttacacatacaggcttgttacatgggcaaattgcgtgtcactaaggcttgatgtatgaatgagcccatcaccaaggtagtgagcatagtacataacaggtagccttccaatccatgcccccccaccaccctccccaatgaagcagtctccagagtctttgttcctatctttgtgtccatttatattcaatgttgagcttccaattataagcgaaaacatgtggaatgtggttgtctgttcctgcactagtttgcttaggataatgacctccagctacatttcatgttgctgcaaagaacatgatttcattcttttttatggctgtgcagtattccgtggtctatatgtaccacaatttctttatctggtccactgtcaatgggcatcttggttgatgccatgtctttgctattgtgaatagcattgtgatgaacatatgagtgcatgcatctttttggtagaatgatttattttcctttgggtgtatacccaatagtggaattgttgggccaaatgatagttctgtttcaagttctttgagaaatctccacactgctttccacagtggctgaactaacttatattcctaccagcagtgtataagcgttcccttttctctgcagcttaaacagcatctgttgtttcttaactttttaataatagctattctgactgatgtgagatagtatctcatagtttgaaatttaatttctctagtgattagtcataatgaacattttttcacgtatttgttggccacatgtatgtctttttttgagaagtgtctcttcttgtcctttgcccacttttaaatgcaattaatatatttttgcttactgatttaagttccttacagattctggataataggcctttgtcagatgcacagtttgctaatattttctcccattcagaaggttgtctgtttattctattgatagtttcttttattgtgcaaaagctctttaagttaattaggtccttcttgtcaatttttgtttttgttgcaattacttttgggaacttagtcataaattctttgcaaaggcccatgtccagaatggtatttcctaagttttcttctagggtttttattgttttagttctacttttaagtttttaacccatcttgagttaatttgggtatatggtgaaaggaaggggttcagtttcaatcttttgcatatggctagccagtgatcccagcaccatttattgactagagggtcccttccccattgcttgttatcgtcaactctgctaaaggacaggtggttgtaggtttgtggctttatctcagggttctctaacctgttctatcagtctgcctgtttttgtacctgaatcatgctgttttggttactgcagccttgtagtatagttttaagtcaggtagtgtaacgcctctggctttgttctttttgcttaggcttgctttggtgattcagtcttttctttgattccatatgaattttagaataactttttctaattctgtgaaaaatgtattggtactttgataggaatagcatctaatatgtaagttgcttttggcagtatggtcactttaacaattctgattcttcctatccatggaataggaagaatatttttccatgtgtttgcattgtctctgatttctctcagcattgttttgtaattctctttgcaaggttctttaaggtccttagtaagctgtattcctaggtattttattctttttgtagcttttgtaagtgacactgtgttcataatttcgttctgagcttggacattattggtgtatagaaatgctactgatttttactcatagattttatactctgaaactttactaaggtcatttatcagttctagaagccttctggcagaatctatggggttttctaagcagagtcatgttgtcttccaagagtgagttagacttcctctctatttggatgccttttatttctttgtcttacctgattactttggctaggatctcctttactatattgaataggaatggtgagtgtgggcatccttgtcttatttcacttctcaaggggaatgcttccagctttcacctaattgctatgatgttggctatgggtttgtcataaatagctcttaaaatttagagatatgttctattgatgcctaatttcttgagggttttcagcacgaaggaatgttcaactgtatcaaaggctatttctttgcctattgagataatgatgtggtttttgttggtaattctatttatatggtgaatcacatgtattgatttgcctatgttaaaccaacattgcatcccaggaataaaccctacttgatcaccgtaaattaactttttgatgtgctgttagattcagtttactagtacttcattgagaaaattttgcatctctgttcattggggatattggcctgatatttttctttctttttttttttttgtttgttgttgttgttgtgtctctgtcacattttggtatcagaatgatgctggcttcaaagaataagctagagaatcccttctcaaattttggaataatttcagtaggattagtactagctgttttttgtatgtctggtagaattcagctgtgaatccatctgctctaggcctttttttttttttggttggtaggctttttattactgattcaatttcagaactgattattggtctgttcaggattttaatttcttcccagttcttgggagggtgaatttccaggaatttatcaatttctttcagtttttctagtttgtgtgcatacagctgttcataatagtctctgaggattttttgtatttctttgagatcacctgtaaagtcacgtttttcatttctgattgtatttatttggttcttctccttttattaatctagttattaatttattatttccctaaatagtcacaaacctaatttgtcaagttatagctcagttgcattacaaaagaagttcttacatcaagtattacagaagaatcagtagtatttgcttgggcagtacatgccatcagattatgaatggattataaatgcaaactgacgtgtgacttttaaaataccatgatctatccaatttgaaagagaccattaaagtggagatttcaactcctaccactataactctaaagtatgatctttactttggcagaatattacagacttagaggtattgtttttatcacttggttttgtttttatccatagcaaagccttcaataatatttcaggccacagagaaaataatacaagtttttgcattgttgatacttcaaccaagatagtcattcttttaatgtaggtctgctggtgtcaaattattttattgttccttcatctccgagaatttcttgatttctcctttatttctgaagagtatttattactggatataggatcctgagttgacaaaattttttctttcagcacttcaaaactattgtaatttttgctggcttccctggtttccgatgagagatccagtgtcatctgaacgttcttttttccacagagaatgtgatatttatttctgactgctttaaacatttgtctttaattttcagaagtttgtctatggtgtgatttcatgtggatttctttgggcttatcatgtttggggtttgcattatagtcccatacatttctgaggttgtgttttgtttttgttttctttaaagtctattttgtccctgttgtttacattgtgtaatttctatttgtattatttttcaatggactggttcttttctctgtctcctctgttcagctattgagcccatatgttgactttttaaattattattttattggttaatatttttagttctaacatttctatttcattcttctttgatttctttgctgtaacattctatttttttattctcctttggtgacattcttcccctttgcttatttttatttttaatttttatggctacataattgtacatattaatggggtacatgtgctatcttgatatgagcatacaatgtataataaaatctaggtaatttgaatatcgattatctcaaacatttatcatttctttgtgttgggaacattccaaatcttctcttcaaccaattttgaaataggtgatattttttcatttgttcaaggatgtttatgattgttcattcatttttatgatggctactttgaaatctttgtaagataattctaacatcgctgtcatctattaaatgtatttttttattcagcttgagatcttcctggttcttgatatgacaagtgatgtttgaatgagatggagacattttggttattatgttaaaagactatggatcatatttaaaattctggatcacatttctgctttagttggcttcttctgaaactgctttggcagaggaagaagagggttgcctcattactgcctggtgagggtaatctttaggggtaaaagtggttctcagttacatggatgaattgtataatggtgaagtctaggatattagtgcatgcattatctgaatagtgcatattgtactcaataggtagtttttcatttttaccccctcaccccttttaagtcttcgatgtctattataccacttggtatgcctttgcatacccatagcttagctcccacttataagagagaaccttcagtatctcgttttcaattcctgagttacttcacttagaataatggcctctagttccaaccaagttgccacaaaatacattattccattctttttatggctgagtagtattccatgataacatacatcacattttctttatccactcatcagttaatggacatttaggttgactgcatatctttgcaattgtgaattgtgctgcaataaacatatgcacacaggcatctctttgatatattcattccttttcttttgggtagatacccagtagtgagattcctggatcaaatggtagatctacttttagctttgagaaatctccatactcttttccatagaggttgtactaatgtgtatttccaccagcagcatataagtgttcctctttcaccacgtccacccgagcatcttttggggatttttttttttgactttttaataatggttattctggctcgggtaaggtggtatacattgtggttttaatttgcatttccttgacaattagtgatgttgagcatttattcatatgtttttgaccatttgtatattttttgagaaatatctattcatgtcttttgtccacatttcagtttttaagttgtctgtttactgtaatgattatttattttgctgtgaagaagctttttagtttgagtcctattcattatttttgttttgttggatttgcttttaggggtcttagttataaattatttgcctatgctggtgtccagaagagtttttcctaggtactcttctagatcttttatggtttcaggtcttagcttcaggtctttaggtctttagtcaaggtaaagttaatttttgtatctagtgagagacagagatccactgtctttcttctacatgtgactatgcaatttttctagcaccctttattgaacagaatgtcctttccccgatttatgtttttgtatgttttatcaaagatcagttggttttaagtatttggctttatttctgagatctctattatattccattgatctacttttataccagtaccatgctgatttggttacgttagccttgtagtaaaatttcaagttaggtaatgtgatgcctccagatttgttcttttcgtttaggttgctttgactatttgggctattttttggttccatgtgaattttaggattgatttttctaattctgtaaaaaatagtgttggtaatttgatagaaattgcattgaatctgtagattgctttggagtgtatggtcattttcatgatattgattgttctaacccatgagcaaagaatgtatttccatttgcttttgtcatctacaatttctttcagccgtgttttatttttcttgtagagatactacacctccttggttaagtatgttctagcatattttatctttttgtagctactgtaaaagggattgagttttttatttgattttcagcttggttgttgttgatgtatagcagtgatactgatttatgcacactggttttgtaatgagattttgctgaattcatttatcagatctaggagtcttttggaagaatccttagggctttctagatataagattatatcattggcaaacaaagataatttgactccatgttttacaaatcgaatgccctttatttatttctcttgtctgattgctctggctaggattccctgtactatgttgaatagaagggataaaagtcagcatccttgtcttatttcagttaataggggaaatactttgaactttttctcattcagtatgatgttggctatgggtttggaatatacagctttaattatttagaggtatgtttcttctatgtctagtttgttgagggtttttatcataaagtcatgctggattttattgaatgctttttctgcatctatagaaatgatcatatatttatttaaaaaaattctgtttatctgatgaatcacatttattcccttgaatttgttaaaccatctctgcatccctaaagtgaaatccatgtgaatatagtggattatttttttgatgcgctgttggatttggtttgctactattttgttgagcatttttgcatctatattcatcagagatttggtctgtagttttctcttttttgttaagtctttcctttgctttggtaccagggtgatactgggcttgtagaatgtattagggaggattctcttcttctcaatcttttggaatagattcaatcgaattagtaccaattctttggatgtctggtagaatttggctgtgaattcatttggccttggactgtttttgtttgtttgcagtgttttggtttttgttgttgttgttgttgttgttgttgttgtttttctaaattactgattaaatctcactgcttcttattggcctcttcaggatttctagttcttcctgattcaagctagcgggggttgtatgtttccaggaattaattcatttcctctaaattttctagtttgtgtgcatagagctcttcacagtagtcccaaataatcttttgtatatctgtagtatcagttgtaatatctccattttcatttataattagtcttatttggatcttctctcttcttgtcttggttttaatctacctagtgttctaacaattttatctttttgaaggagctattttttgtttcattggtcctttggattttttttgtttcaattttatttagctctgctctgatctttattattccttttcttctgctagctttaggtatgtttttttcttatttctctggttccttcagatgtattgttaggctgtcaatttgtgatctttcagaattattgatgttggcattttgcactataaactttcctcttagctttgcttttgctgtatcccagaggttttgataacttgtgtcactgttgttattcatttcaaaaattttttaaatttccaccttaatgtcattgttaacccaaaaatcattcaggagtagattgtttaatttctatgtatttgcatagttttgagggttccttttggaatcgattcctagttttattttaccgtggtctgacaagaaacttaatatgattttgatttttaaaaatttattgaacttatttagtgacctatcatataatctatcttggagaatcttccatgtgctgatgagaagaatgtatattctgtagttcttgggtagaatgttctgtaaatatctgttaggctcattttttctagactgaaatttaagtctagtgtttctttgttgactttctgctttgatgatctctctagtgctgttagaggagtgttgatgactcccactattattgtgttactatgtattttcttttttagacctggtaggaattgccttatgaatctgtgagctctagagttcggtgcatataaatttagacatgttatatcttcttgttgaatttatcctattttaattacataatgaccttctttgtccttttttaatattgttgctctaaagtctattttatttgttttaagaatagctactcctgcttgcttttggtttccatttgcaagaaatgtcttttttcaccccattagcttgaatctataagaatctttacatgtgaggtatgtcttctgaagatagcaggtatctatttggcttgcaaatttttaaaatccattctgtcagtgtgcatctttttaaagtggagcatttagaccagttacattaaacattgagatgtgaggtgctgttctagtcatcatattgattgttacttagtgactttgttttcttcatattgttattgttttataagccctgtgaattttatgctttcaggagtatttattctggtgagtaacaacaacttgtttcaagatttagtattctatttagcacttctcatagagctggtttagtattgacaaattccttcaccatttacttgtctgagaaaaactatttctcctttatctatgaaagagttttgctggacacaaaattcttgaccaacagtcattctgttcaggagactaaagataggaccccaattccatctggcttataaggtttctgctgagaagtctgcagttagtttgattggttttctgttataggttacctgatgcttttattttactgctcttagaattttttccttcatgttgactttagatagcctgatgagtatatgccttagtgatgttttgtttttgcaatgagtctctcaggagttctttgaccttcttatatttggatatctatgtcactagcaagtccagggaagttttcctccctggaaattttcctcaaatagacttttgaaatttttgctacgtttttctccctcaggaatatctacaattcttatgtttggccattttatataatccacatatttcttgagactttccttcttcttttaattcttttttgtttacttttgctgtgctgattgggttaatttgaaagccttgtttttgagttctgaaattctttcttctgcttggtctaatctattttaaaagcttttcactgcattttgtagttgccgaaatgtgtagtctttcatagaagttctgattggctttcctttaaaatatccatctctttagaaaagttttcattcatgtcctgaattaaaaaaaattatgttggttttcaactttatgttaacttaataatcaacttttttgaattatttatctggtattttatgttggttttcaactttctcttatgtctccttgattaacataataatcaactttttgaactctttatctggtatttcaaagatttcatcttgatttggatccactgctggagagtcagtgtgattgatttttttgagttgtcatagaacaactcaaatgttttttatgtttccagaattgtttttatggttccttctcatttgtgtaggctatttcttctaattattttaaaattagtttttgattcaattgggtttaaaaaaattttcctccttgaagatgtgactttaacatttatagtttatttacacttagtttcagctctgggtggtttcaagtggcaaagactgtatgagtttcttggttatagagaatcattgtgaagtgtctttctcagatgccggttgtagtggcagtgggctgggtgtgtgagtaggttcactgtctcctaaggggctggaatggcagaggtctcatgaagcttattttgttccccagtggtgtgcacctttaaaagtttttcttccagcattttattcaacgggttgagtagttcaggcttcaggccagtaggaggtgcccacagataaacacaggttgtggctaaagcgggtgggtaaatgtaatatccaacgattggatgaagtcccagctttgacagaggcagctggcaaagctctccgtgaaatacactgaggtcttttcatggggaagtgaaggagccaccccagctctccttccaggcaaagcaggaaagcaatccacctcccagtcacactgctgacctggtgttctagcttttcagatcaaacaggtatctctttctatctgcaagaatgctgatgttccctctaaagaagggttgtagctctacctcttgtgtaagtctgaacctgtatggcacacttcctgtggatagttaccttggagtgttccagaaagtctgtctacagatgcatccatgctgagctcccatgagagaagccccagctctctgcagtgttgggtgaggggaaaaagaaatcaccttctcaaacctttcatgagcgctgtttgactgttggggtagagctgcagactttccccactgagcccagcactgcacttgtgtctctcccgaaagaaacttctcacaagtgggaagttaagggactcaaggcccatggtctgctttcttttataccatgggatgctcccttaatgtggttcactactctttccccaaaaaatagtagtccctgaaagccaggctattctgaattctactgctcctctaggtctagctgtccagtggggctgccacagttcaggctgtactggagaatatctgcaagggatccagtgatgtgaactgtcctctagtttcccagcaccaggtgccagcattacctctgatgggggtgggtggggagtgacacagactctgagattttcttggttataaatagctttagtgttttggttttctcaaatgccagctgtagtagtagtgtattgggcacatagacagactcaagacgtcctatttagctaaggtaatactggcaatggcaatagctgaggttgcataaaagtttttggcttcctgagtgctgggttattgtttatgcagatgttttaatgggctgtgccggttggcctccagccagtaggtcatggcttgtagaaaagcaccagctgtggaggtagtggtagaatttgtgcttgctttatgtcactcaggggaggtattcctgtgtctcaggtaggtaatgggtagggccatggagctcccaaacatccctgtatattgcactgtgctaccagggcaggtggaggggcaaagctgggtatgggctaggtcaggcaactccttgctctggctcctcacatgcaggcacaagcagcggccccagtgaggatcataagtcaattccttggctactggggtaatatttcagggagtagcacagctgcctctgttgcacagaagaatccgcatgggatgcaggggttagcaagcagcagtaagccccactcagctcccatgcacttggcaaggcatgtatcccactcataatgttcgctaaaagcagcaggctgggttccaggtagtctgtacgtagaactaaaaactgccccaggccataagccgtcccagtggagaccagtgaaaccacagctttcaggccgcaccccttctggtctacctgtgaagcaggagtgcccagctcctgcgcccatggctatagcaaacttactacttgcccctcatttctggccaacagggtttatcctcactcaaggttataatctcatatctcagatgggagcttctctcaacctgtgactgcagcttgagttagctggtagacttctgtgaggtcccctgtgaggtaggatcaggaatggcttccctctgtccttgctggagtgtgaaagtgcaggcaatgtgcatcctgataccgcttcttctcaccccatcactcgctaaatcagctccagcactgggtagtgttaagatctgcctccatggcctgaattgcccggctctccggtgggagtgtgtgtcacggtggcagtctctccccctctcacacactctggagactcacagttttccatctggttcacagtgtaggctgctgtttcttctttcaaagggtctgtagtttctttcagtttttctgttaagttcctgtgttgcttcttagaaagaagtgcacattgtgaatctctgcacactattttgtctttccaagtgggagaggcaggctaacaatgcctccaaaccactgggccattttaaataacacataggccagattttcagttaacacaattcttaaaacacctgcaacttagcatgcttctatttgacatcatttgggggtctgttacattatttgagaagtctgctgttagtctgataggttttcctttataggctagggtatgcatttgaagactagttagcatatccactctatttcatttatctaattatcccatcactctcataatccaaaagtcagacacgaagaaaaggaagaataccagcatatttggatgggaataaaagacaagaaatttcttgagcatcaatattaggtgcatgaaatcttgggtaatctaaggtacaaagtaggagttggacttttgaggatggacaaggcaaaaattcattacaattgaacctaattataaggatattgccaagatattgctagtgggagtacagtggagataaaagaaggtctctgtgtctgaagccaacatcagttaaagtgcctttggttataaaaacccaaaatttaactcaaacagactagtaattaaatacatttgttaactcaggtaacagaaaaattctagttttgtttcttaagtaaggatagatctgacagctcaacaatgtcatttaaaatgtatcttgtttttcttttcccttgatttacattgtgctttctgagtttcactttgtcctgaagttggtttcctttatagttataagagggcttccagtgattcttaggtttataagggtcattggtcacatcacatccagagagagggggatcaaggagaagatggggataaatagaggagaggggaagcagaaaaaagaaagagggatgaaaggggtgggaagttccctagctagataatgaaattcttctatttcactttgattgtggcaatatatatccatgcccaataagggagttggtttgggttaatcagtacctgcccctaccccatgaaactgagaaagtgaaatagacatgagaaaaaccaatagtgttttctacattaacattttctctttactataaacacccatggttgttcctctacatatcattgtgcatcaacatcaaggagcttcccctcccttgggttagaaaaccagtgcacatatttgactgggtttaactcatcagtgataaaagcacctattcctttttacaattttcaagagtggaatatacagtcttaagaaatggcatacaagttgagatgttgtcatattaacagaaataatggcagctgtttaatctgttctaaaacatatgatttaacatgctttgactcatcatttgtttccattgctttttcccttagataagatcacttaaaaacagtgttaatcagataaaaggaaggaccatcccacacatttcaatgggaaaaaagccagtgggctcagtgtactgtgatatatgaattgtttttgtgattcccatcataaacgctgccttaactgtgttatttttttaactataaagtagaaaaaaataaattactttgctcttaaggagtataaagaaatattgaaaggagtaagattttttgaaaaaaagtttggtagcctaaaatatgtttagataatattgaagtttgtgaactgctaattcaatggtattgtttcaatcaaattataatgtaaaatatctgttatgtgtttaaagtatgttttacaggtataaactaagttgaaggcttcccaaaatagaatattaaatctagaaggaatattagacatctagtccaaatctacccacttacaaaggagggactgaagaatctgagagtttaaggttcaagtgacttgcttaaagccacatcattaattagtgaaagaagactagagcacccatttccagactggaagcccactgctctttcttggtttgacatacatgaaatatgaaatcacccgtaccagacaactggatactggcaaaatacatgttacatatttcattttgagacaaaagtgaaattcagattatcctaccatttatcaaagtgtataattaaagcaacatacatccatctagatacaaatctgattatgattcggttaaaacagtctaaaaagtgaattaggaaaatatacaacaatgagaaaaatgaggaccatgaatcagaaagccagctttacatttgattcagtgagggtaatttcatttattaaaattgctatggcatttatattttaacatagtcatgtaacatgtgaggataatgttaaaaatagttatagtttgccttatttctagagggagaaaaaatacttttcagtagttctaaagagggagaaaaaacagtattagaaaaattataattataaaggccataaaatatcttcctaactgataatgcatttgattaatagagggagaaaaatggcttatatatgtgcagatataaaaagagatggcattgctaatatatctaaggcatcaaagttgtttgtggaatctataaacacagggacttagtttttcacacagagtacaatttaatacggtttactgagtgggagtggttttaaatgataattattttcctgtcttctcttattaagaaaatcaaaacaacagttttgtcccattttgctgacactggtttctgtagtgtgatttctattgaagcgggaaagaacagaacatcatctgtatcattttaagaacttgagttgtctcctagaattgtttataattgcccttgcaaaagagagcagcctcagcaggttggaaaattaccaatcagtcaacaagtgtttattgaactccagctatgtgttcagaatagtactgagtggtatataaaacatatttttccccccttggggactttcagtggaaggaagattgttgggaatattatcaacgcacatggaataaagagcaattaagtaccttcataattaaatatggtctatcagtgcaattacatatcagaaggaaaagatatcattttgaataagagcagcctgaaggcaacatgagagagataataaaatctcaaaatcattaatgatggaaactgctttacttgatcactgttcttaaagcaacccattcatctgttggctgctctgactctagaagagatgctcttgacattgacctgaaacttacccctcttttacctccagctatccacccatctttagctaactctcagctgttccagccctttcctgtggtggaattttaatgcagcaataatattcccacatagtattctctctttatcctgtcagcaatgataatgatgccatcctgatattcatcatttttttgctctatactttgttaaaatccccttaaatataatattcagaaataatacaacactccaaataagcattggcgagttaataatacacaggaaaaaaatctttttcttgatctgaacactatatttctttaactacagaataagagtatgttagttttattgcccgtatataaccctatcagctcatattgagttttagcaagttttatttgacctctcccatgaattgcagtcaagcaaatttgtaaggacttataaatacaagcgatgaatttaattggaatgtagactttatagttattgctgttaaatgttccttgttgatttctgaatcattattctagcttggcaaaaaaaaaaaaatggtgactcatgactcaaccatccataacattagcttttcctcctgaatttacattaaccacaaatttaataaattagatatctggtttttcaacagacctatacaataatacttttcataggattgttgtgagaatacaaataaaataagatcatgaaaaaagtatttatcacagtttttaggaaacagaagttccataaatgtcagattattttcctttcttcaaaaaatatttgaaaaggacataagcaagttcagaatctccttcaggataaaatttacctacttaccaaaaccctttgtgtcaacctcctacaatgttccccaattgtactaacatccaacctccacttttccatcctggtcacaaatatataattgaagaccacattgataaaatgtatcattgtatcagaatgtatatgacagatagaatgcatatggggagtcaaaacatatagaattaaataaacataggccagtcctctacagagttataagcaaaagctgagacacagaaatataattggtaaatttaaaagatgaagggatggatatatgttagtgtgggttgaagaatggtaatttgtgctgggttttaaaacaataaaaggagatgggaattgatacagaaagcaatagcagccactggatgactttatgtcaaggtttggcagaaagaggtgggagacaccaaagtgtctgcacagggtaaatatattaggcatataagttagagaagactttcatggaggtaggaggtaagctactgtaataatagaggccagaagcaatgaaaatctagtttgaaataatggtaatgataaccgagtaaaagttgtgacttctgaattcacccattatggacaatgaagaagaaggcaaattcaataattttcagaatcatgccactaagaaatttataagacggaaaggaaagaacatttgagccatattatggaataaaacaaatttaatttttataattttcaatgtgtggggctttgaccattgcatcagcattatgtaagaatttattagaaaagccaattcataggatcttgcttagacatactgaattcaccaatactggtgtgttggtgatggtggcagggcagggtgagaacagaactaatctgtaacgttgaagatttctgacttttctgatttttgtactcccaccatggccagtttcaagtcactggtgacatagagttgtgaataaaagtgcacattctgctccccagactctctactaggccactcatgcacaccactggctccaggtgaatctgtagtttgcatcagaatcagctggatgatgatcaaaacacagttggaccacatcaccaaagtttctgtttctttagatctagggtagggcctcaatatttgcatttctaagtttccaggtgattttgatactcctggtctggggaccacactttgaatatcactactttaagtgtcccttaagccaccttatttagaaatttaattagcatacagagccgtaattgccaaagtcacattgaatcaaagtgtttttattacttctgtttgtgaccaaaatccaaaaaagcagtctcaagttctcatcatacttaaggtctcaagcaggaattgccataggttaaacatatccttcttgaaactatttccttagtgttccactatccacaatctcgtgattctctttttccttctttggctattcattctcagttgttttctgtagattactccttccctgatagctgaattttgaactaggcctcattgctttccttttctgatggctgaatcctccctctatgttatattatccctatcccatccaatggttttaaatatcaaaatgttaacaactccaagttttcctgcctaaagttcttctctgaacttcaaagtagaaatatctcttccacctgacacttccatttgggtatctgaaacaatactgaccaaacggaatttgtttctcccctgcacctcatgacatctcctcaaatctttcccagctcagtaaatggcaacactatccactgtgatgctctgacctggaaccccagagagtctacacctcatcttgcccttttagcacattctacatccactaattcctattaccactctttccaaaacattttctcaatgtgacaagtttcattgtttccacaaccaccacctttggttagtccactatgattctttcccagacaatttcaatagcttcctacttccatcttgtacccttataatccatttgtcatacagccatcatggatctgattaaattcttcctgttttactgcagtacccttagaatgaaatctccttccaaagcatagccctacatgacctggtccttgccctatcttccctattccctactcaagtctgcatctcttcattcaaacaggttgcagtcatcccatctggatgcttttgcatttgtttcttctgcctgaaaagctcttctcctagaattgtacacggttttttcctttatgctataaaactgtcaattcaaatgtcaccatctgtagcaaggcatttttgttttttgcacacagtccttttctatttcataatttatctgattttcctgatatggtagcatgtagtatggtaggcaacagtatggattataaagccagatcatctaagtatgaatcttaactcttgagcttctttctctaaattaggcaagttacaagaatcttttgtacttcactttccttatctttaaaaatgtatacataataatatctgccatataagtttattgtaaggattaaatgagttaatatataaaaattatttataactgcatctggcacatataagaactacatgcatgttagcaattattatccacaattatctcgtttgagtgatatcagcgagattgtggaactggagatcccagccctcaacccccagaagaaacaacaattttaacaaacacccatggtcaaaaatacctttatgtgagctcaagaatccagctaagattccactgttccagcatcacagtggaacgacaacaacaaccaaaatccaagaatagacgcattaaaaagcacaagaaaaacaatttcactttacctatctcaccaagtgccaagagagacccataaaagatgcatttagtttgaatgtagactttatagttattgctgttaaatattccttgttgattgattgatcttatttattattattattattattattattatttgagacagagtcctgctctgtcacccaggctggagtgcagtggcgcgttcttggctcactgcagcctctacctcccgggttccagcaattctcctgcctcagcctcctgggtattacaggcgcatgccaccacatccagctaatttttgtatttttagtagaaacggggtttcaccatgttggccaggctggtctcaaactcctgacctcaggtgatctgcctgcctcagcctcccaaagtgctgggattataggcgtcagccaccgcacccagcctgttgatttattttttaaaagagacagtcttaatctgttgcccaggccagagggaagtagtaggatcatgtgtcactgcagcctcaaactcctgggctcaaatgatcctccccccttagcctcttgacaagatgggactacaggagtgcaccactgtacttagctaatttatttatttatttatttatttatttgtagagacgggtttcactgtgttgcacagactggtcttaaactcctggcctcaagtcatcctcctcaagtcatcctcgacttcccaaagtgctgaaattacagatgagagctaccatgcccagcctccttgttgacttttgactcatttttcaagtgcagcaagatatggtgactcaataactcaactgaccctcgtcctacaatttctctcatgaagaaaagtgggagcagcttccttccttccaaggagacccacttctgtctcatcccacccagaatactaaggggattagcaaaatgaaataatcttggggacactaggaacagggtaagggggtaggggccgtggcagcctgtatgaatatctcaacaactggccataaatcccactggctggttcatgatggtctccactaggatctctacccatgacccctgtggactcccccagctaactgatatgtattcccaggattccatgcccctcaactaaaatggttagagccctgctgtctactacatatggtaccctatgctcacccacagacaaaacattgagcctttgcaagacagcatgtgcaagctcccaaagatggcaagcaaataccagcagctggcttgactctgctggattgggaggagtcatactatattaaacaattcaggacactgtcttaaggaaaataagtgagagtctcttagcaacaagcctggctttgcatgatcaagagaatatacaaaatctaaatacttacctctttgaagagaaaagagaaatagagtgggtgcctctacatacaaaaaggtctgaaagacccccaaaatctccaacggggctgactggtcaaggtttttctttcctaatatcagacagtaaacactgaaggagatgactccttcttcaaatgtgaagacaccatcaaacagcttcaagaaacacaaagagtcaaagaaacgcaacaccaccaaaggaacaaaataaagttccagtgactaatcccaaggaaatagacatctaacaattgtctaacaaagaattcaaaataattgttttaaaaaagcacagtgaaccaccagagaacacagatagatacctaaataaaatcaagaaaacaatacatgaacaaaatgagaagttcaacaaaaagatggaaacatattaataaaaaagaacaagacaaattcagcagaagaataaaattaatgaaatgaaaaaatataatagtaagcttcaatagcagactcaagcagaaaaaagaaccagtgaattcaaagacagaccatttaaaattctccagtcacagaaataaaggaaaaagaatgaagaaagcctatgggaattatgggattccatcaagcaaactaatagctgcattatgggagccctataagcagcagagaaaaaggcagaaagcatatttaaagaaatcataacagaagtctttccaatctggggagtaaaatgaacaccagatctatgaagcccaaaggattcataaaaaagccttcactgggacacattataatcatattattcagtgggacacattataatcatattattaaaattgaatgacacccatgtctgtaatctcagcactttggtaggctgaggcaggaggatcacttgagcccaggagttaaaggtcagcctggtcaacatggcattttatttcatacatatatatatatatatatatatatatatatatatatatatatatttattaaaaattttaaaaataacaaataaataataaaaatcagttacaagaaactctgaacacagaaagagaaaaacaacttgtcacatacaaaggaaccctcatgagattatcagttggtttttgtgcagaaaacttgcaggcacaggagagtgcggatgatatactccaggtactgaaagacaaaaaaatctgtcaatcaatgatactttacttggaaaagctgtccttccaagaaataaaagataaagacttttccagaaaagcaaaatctgagaaacttcaccaccattagacctaccttacaagaaatgggagttatttaatattttatttgaaacaaaagaaggttaattagcaacattaaatatatgaaagtattaaacactattacaccgctattagacaccgttagaaaagaaaatcagaggccaatatccctgataaatgtagatgcaaaaatcctcaaaaattactagcaaaccaaatttaatagcacattaaaaggaacattcaacatgaagaagtgggatttatcccaggaattcaagaatacataaatctgtaaatgtaatatatcacatttacaaaatgaaggacaaaaaaaataacatctcaatagatgaagaaaaaagcatttgataatatttgacattcttttttgataaaaactctcgacaaactaggtatagaaggaatatacctcaacacagtaaagtccatttatgacaaatccacagctaacatcacactcaatgatgaaaatttgaaagcttttactctaagatcaggaataagacaaggatgcccattctcatcagttctatccaacattgtactggaagtcttacccagagcaattagacaaaggaaagaaataattggcatccaaattggaaatgaggaagtcaaattgttcttgtttgtagacaacatggtcttatatatagaaaaccagaaaaactccaccaaaaactgttagaactaataggcaaattcagtaaagttgcaggattcagaacatatgaagaatcagttgagtatctatacactaatgatgaactacaaatcaagagaataattatatttacaatagctacataaagaacaaaatacttaggaataaatctaactggaaagatgaaagacctggatactaaaaactagaaaaaattgatgaaagaaatttaagaagatataaagaaatggaaagatatctgtgttcaatgattggaagaattaatattgttgaaatatttgtactatcctaagtgatctataaattcactgcaatctttatcagaatcccagtggcattttttacagaaagagaaaaaaactgtaagtcatatggaaccacaaaatacaccaaataaccaaagcaattttcagcaagaagaacaaatctagaggcatcacactccctgattttgaaattatatcacaaaggtatagtaatcaaaacaatatggtactggcataaaaacagacacatagaccaatggaatagattagagaccccagaaataaacccttgcatatacacatttgttataaaagcttgagaaagctacaaagaactgcaacaaatgactgaaatcatacttttgttcaggctttcaaatatttgcctttgaattccatgatttctaggcagcatctggcagaaactgaaataatgattattatttattgacagttgacagtatattccactcagagaggcaaagacttcaatggaaagatagctgtcaactctttattaacatccacaaagcttggttcataggcacaggccataaacttaagtattcgcttaagagaaaaaccatgaattatttctggaatgctgacagacagttttgcagtcatggctgtactattcccttcaatttttggcccatttctcctaggctgcccccatgctagagtttgcttttctatcccagaactcctatactttggattacccatgaaatatttcttgttacacaacaatacattctgaaaaaatacagtaacaccatataagcctctgaaaactcattacaggtgtttttcttttcttcttctactttttttttaattgggtgggaatgagtgacctcaaagtgtcttaggaaatgagttccagtgtttgctttaagtccttcaaaagaaactgcaccataagcaaagaaactgttcaccacagttccttccagacttacaccatgccagtccacatattaagtaactctctggcctccacttaccaccaacataattcaaatatcttcaacatcaccaccaaaaatattcaatagcacctatatgtgagacagagtaagtgtacattctcttaggtcactatgttacctagagctaaagtctttgggaaatgttcacttcttattcaattattcatttttagctaataacttgccagattagaaaaatgacttaagatagtacaaagtcattgttgatatggaaataaataataaaaaacaaagtagacaaaagaagcatatttaacaaccaggctaacacagttgctgagatagaacctcaaatttatgttgaactcacctataataacaacctaaagaggaacacattaagttatataatttatttaatgattaaagatccgatattcagaaaaatggtttttcatgatagtaaattatttaaaaattaggtatattgccctggatcctaagcagaaagttttaatacaaaatattattttaaagaaaataagaacatataccttgaaataatgtaatttttaaaattcagtcaaattgttttttccagtatcactcatgtgcgtgttcaagggaccatatattgctctaataccttgaaatatacacttttatacccaaacaccacccataaaaatcagccttttaatttttagtcaaaagctttgactactagatttttgaaaatattatgccaaaattgcataacacactgatccatcattttttacctgagggagttcctgttaagtaaataaggatgttaaatgatttggcaagaactgtattttaacttcctccccctctttgctgtgtaatcttacagaacccccaaaatctctcttggtatcaaatcttaccaagtatgatacagaaattgtaaagcctgttttaataataaagtgatacataaatgtcaagtaatattggcatcctttctaatggagctaaggccttcaattatgaaatagcaagccctaaatatatgacagtcaaaagcattgcagacttaaatgttgaaaagtaagattcctgggatattttctttatcacgtcttttacagcaaggggtagtagaaaagtctatgttctttggagaattacacaattatgagtaaattaaactctgatgaaataattctaaaaccaagaaaattattagtgttcaaatcctaaagcatttttttttgttctttaactttggagtagtcacctaaaatctctgaatttcttcttctttataatagaatgagcccagtaatgtgtatgtcacaataccattgcaagaattaaatatggtagctctaggaaagtacctgccagatctcagatgcatgagaagaggtcatcttttcctttataaactttcttaccaaacgcacaaccatagcatgcccagaaggtatctacatgttcaaaagcagattcatgactttaatttagcattcaacgagcagaaattgagaaattgaaaaaaaagtagtttattttgtgagatatctaactcatgttgccctccattaggcaaaaagtagaattttattgtgctataagtacagttattttatttctgcataagcatgacagagattaaagttatttttaaaataataaactatgcaatatcatattgatagcttgctaattactagaaacaacatttgactctcaagttctccaaaaccagttcattctttctatggagcaattaccttatagcttctggatctcaatgtagttctgtttcagctccctagaccaagtttctgcacactgtctgttatactaaccatctgtaatgggaggactgcttagactgttttaaattacccttgtcacattctccttgggtaatccaaaatgacaaatcttattttacagaatattgctaacaaacgcagccttagaacagaaaaaaatagaaagtataggatgaaaaaataatgactattggtgtacatataatagacttagtgacattcatgcttaagtctgtttcattgctttttaacactacctttcccagatcgtcgccccaaccagcttatatactccaagaaatctggagtgaactgccagtcctaaacttttaggttcagtgtagatatgaaattagaatactctcttcttgaaaagaaatacagaaaacctctctaaatctaaattaggatgtaggggacactagcattgtcagttatgacacataaaatgagagtgcagagactttcagttatagaactacaatttgtaatcttgattgtagtacaaggaagaggatgaatgattgcttagatttgtataaggtcttttggttggaaaacttgtcatgactgggtatagaagttcttaggatctatgggcatgggtaattttcatattaaccctcaagacaaggttctgggaagaaatagtcagacattctccatttggttaaacatcctactacaaatgacatttcatttcagcctcacatttaaaatgacatttaaaaataatgttatgaacaaaatatttttcagcactaacattaccttctgaattacataaaagtatcttaagttttaaagctttttttaaaaaaactgtttatgtatttaaggttaatctaagtgtgaaccacctacaagtccaggatatcttatttacttactgattaataatcagtgaaagctcatactaatatttagctccacaagcttgagttcactatataaaaacatactttagaaaatgctgctagaattgcttaaaagcctactgcactatgtagattctgaagacaaaaggcaatattgaaaaattaccctgataccaacaccagagagactcaacaaaaaaaggaaaccgcagaccaatatatctgacacacatagatgcaaaaattttcaacaaaatattagcaaacaaaaatcaataatacattaaaaagatcattcaccatgaccaagtaggattcatcccagggatgcaagaatcttttaacatgtgcaaatcaaaaaatgtgatacagcatatcaacagaatcaaggacaaaaaccctatgatcctttcaatagatactgaaaaagcttttgataaaattccatatccctttatgataaaaatcttcaacaaattttgcatagaagaaatatacctcaacacaataaaggccatatgtgacaaacctatagcaatcatagtgaatggggaaaactctaagccttttcactaagacctggaacaagtctacgatgcccacttttgccaattttatccaacatagtactggaagttctagtcacggcaactaggcaaaagaaacaaagaaagggcatccaaattaaaaaggaagaaagtctaattatcctcgtttgtatatagcgtgattttatatttagaaaggcctattataccaaaaaattcttggaatagatcaataaatttagcaaagcttcaggatacaaaaccaagacacaaaaattaatagtgtgtctgcaaactaacagtgatcaatctgaaaataaaaaacaagaaagcagtaacatttacaatagctaaaaatatatatcacacataagaataaatttaatgaagaagtaaaaggtctttgcaaagaaaactgtaaaacactgatgaaataaattgaagaggacacaaaaaaatggaaacatattctatgctcatggatttgaagaattaatattgtcaaaatgtgtctactacctaaagtgatctacagattcagtagaatccttatcaaatattaatgatattcttcaggtaattacaaaaaaatcctaaaatgtgtatggacacaaaagactgaatagttaaagcaatcctcagtaaaaaatgcaaagctcgacatcatactacatggttttcaattgtactacaaagctatagtaactaaaacagtatggtactagcatgaaaaaaggcatatagaacaatggaacagaatagagaatacagaaataaacccacactattacagccaactgatttttgacaagagtgccaaaagcatacatcagggaaagacagtctctttaataaatggtgctgagaatattgtatattcatatgcagaagaataagagtagattcccatctttcaccatatacaaaaatcaaataaaattatattaaaaacataaacataagatctgaaactatgaagcttctagaagacaatatttggaaaacagtataggacactggtctgggcaaagatttttttaggtaagacctcaaaagcaaaggtgaaaaaagcaaaaatagaccaatgggatcatatcaagttaaaaaagctactgcatagcaaagaaaacaattaacaaagtaaagcgacaacctacagaatggcagaaaattatttaaaaactatccatccaacaagggattaataaccagaacatataaggaactcaagcagctcagtagcaaaaacaaagaacaaaaacaaaaacaaaaaatccaattaaaaaatgagcaataatccccatgctaacaccaccaccagtgtgactgcatgcacattcgccagcaggggccccccgttcccctgactcatgctgcctccaccgctgtggtgaatgtccgcatggaggcaggtacactgacacccattagcaccctgctgcagccgatgagcgtgcaccctgccatgctgtggctgccactgctgctgacatacgcggatgaagacagatcctgctgtcaccatactacgaaatgctttggctgacaccacccatcagagagtactgaccagcattctgggagtacctcggccccctagtgtagcagatttctaacctcaaagaaccaaagaacactctcaggtcaccatactactcccccagagttacagcacccagtacaggagctgagagctaagtgttcactccctaaagtcttccagaaacaaagccagttggcagaattcacttcatagcataatcaaaccctcagggtcatcaaataggataaaagcaaaaaaaaaaaaaaatccaaaggtcaacaacttcaatgactgaagaaacattagtccacaaagatgagaaacaaccaacacaagaactccaacaactcaaaaagccaaagtgccttttgtcctaaaaatgaccacatcacctctccagcaggggttctgaactgggctgagatggcggaaatgacagaagtagaattcagaatatggataggaacaaagatcattaagatgcaggagtacattgaagcctaatccaaggaagctaagaatcagaataaaacaacagaaacggacagacaaaatagccagtatagaaaagaatgtaagcaacatgatagagctaaaaaacacactacaagaatttcataatgccatcacaagcattaatcgtagaatagaccaagttgaggaaagaatctcagaggctgaagactagctttctaaaataagacagtcagaaaagaatagagaaaaaagaatgaaaaggaattaataaaacctaagataaatatgagattatgtaaagaaacaaaatctatgactcattggtgtccctgaaagagacagaaagagtataagcaacttggaaaacatatttcaggatatcatccatgagaacttctccaacctagctagagaggccaacattcaaattcaggaaatgcgaagaaccccagtaagatacttcacaagaagatcgctccaagacatacaatcatcagattcctcaaggtcaaaatgaaagaaaaaatgttaaagctgctagagagaaaggccaggtaacctacaaagggaagcccatcagactaacagtggacctttcagcagaaaccctacaagccagaagagactgggggccaatattcgacattcttatagaaaggaaatctcaacccagagtttcatatccagccaaactaagcttcataattgaggtagaaataagatccttttcacacaagcaaatactgatggaatgtgttgccaccagacctgccttacaagagcttctgaaggaagcactaaatgtggaaagactgttaccagccactacaaaaacacacttttaaatatacagaccagtgacactataaagcaaccacacaaacaagtttgcacgctaaccacctaacatcatgatgacaggatcgaatccacacataccaatactaaccttaaatgtaaatgggctaaatgccccaattaaacacagaggggcaagctgaataaagaaccaagactgatttcacatgcaatgacacccataggctcaaaataaaggaatggagaaaaatttaccaaataaatgcaaaacagaaaaaagggaggttgcaatcctaatttcagataaaacagactttaaaccaaagatcaaaaaagacaaagaaggacattatataacagtaaagggttaaatacaacaagaagacctcactatcctgaatatatatgcacccaacacagaggcgtccagattcacaaaagaaagttctctgagaccttcagaatcttaggctcccacacaataatactgggagacttcaatacctcactgacagtattagatcattgaggcagaaaattaacaaagattttcaggacctgaactcagcactggatcaaacggacctgagagacatctacagaactctccactaaaagcaagagagaatacattcttctcatcaccacatggcacataccctgaaataaatcatacaatcagacataacacactcctcagcaaatgcaaagtaactgaaatcataacaatcactctctcaaactacatcgcaatcaaattagaaatcaagcctaagaaattcactcaaaaccatataatccatggaaattcattacatgaataacctactcccaaatggcttttgggtaaataatgaaattaaggcagaaatcaacaagttctttgaaactaatgagaacaaagatacctcacgccagcatctctgggacacagctaagacagtattaagaggacaatttatagcactaaatgtccacatcaaaaagttagaaagatctcaagttaacaacctaacatcacaactaaaagaagtagggaaccaacagaaaaccaaacacaaagctagcagaagaaaagaaacaaatcaatccaaattagagctgaattgaaggagactgagacaccaaaaagcattcgaaagatcaacgaatccaggagttggttttttgaaaaaattaataagttagatagacatctagctagactatcaaagaagaaaggagagaacatccaaataaacacaattaaaaatgacaaaggggatattactgctgaccccacagaaatacaaataatcatcagaaaacactatgaccacctctacgcacataaactagcaaatataaaagatgtggataaattcctggacacagacaccctgccaagacagagccacgaaggaactgaatccatgaacagactaataatgagctctgaaattgaatcagtaataaatagcccaccaatcgaagaaaatgcaggatcagatggattaacgacctcattttaccagatgtccaaagaagagctggtatcattcctcctgaaactattccaaaatattgaggagaatggactccttctaactcattctatgaggctaccatcatcctgaaaccaaaaccaggcagagacaaccaaaaaaaaaaaaaaaaaaaaaaaagcaagaaagaaaagaaacttcaggccaatgtctttgatgaattttgaggtagaaatcctcaacaaaatacctgcaaactgaatccagcagcacatcaaaaagcaaatgcatgatgatcaaggaggcttcatgcctgggatgcaaggttgattcaaatcaatacatgtgatttatcatataagcaaattaaagacaaaaaccacatgattatctcaatagatgcagaaaaggctttcaataaaattcagtatcacttttatgtcaaacatgctcaataaactaggtattgagaaaacatacttcaaaataataacagtcatctatgacaaacacacagtcaacattaaactgaatgggcaaaagctggaagcacttccttgaaaaccagcacaagataaggatgctctgtctcaccattccttacctaacatagtattggaagtcctggccagagcaatcagggaagagaaataaataaagggcatgtaaacaggaagagggaaagttaagttattcctgtttgcagatgacatgatcctatatctagaaaatcccacagtctcagctcaaaaacttaagctaataaaaaaacttcagcaaagtctcaggatacaaaattaatgtacacaaatcactaccattcccatacatcaacaacagtcaagtcaagagccaaatcagaaatgcaatcccatccacaattgccacagaaagaataaaatatctgggaatacaggtaatcggggaggtgaaaggtctctacaataagaattacaaaacactgctcaaagaaatcagagatgacacaaacaaatggcgaaacgtcccatgctcatgaataggaagaatcaaaattcttaaaatgaccatactgcccaaagcaatttatagattcaatgctattcctattaaactaccaatgacactcttcacacaactataaaaaaaactattttaaaattcatatggaacaaaaagagcccgaatagccaagacaatcctatgtaaaaagagtaaagctggaggcaacatgctactagcttcaaactatgctacagcactacagtaaaaaaacagcacaccaaaataaaaacagagaccaatggaatagaatagagtatccagaaataaggctgcacacctgcaaccatctgatcttcaaaaaaaaactgacaaaaaacaagcaatgggaaaggattccctgttcaataaatggtgctgagataactggctagccatacgcagaaggttgaaactggaccccttccttacaccatacacaaaaattaattcaaaatggattaaacatttaaatgtaaaaccctaaccaataaaaaccctggaagacaacctaggcaataccatgttggacacaggaatgggcaaagatttcatgacaaagacactaaaagcaattacaacaaaagaaaaaattgacaattgggatataattaaactaaagagcttccgcacaacagaagaaacattcaacagagtgtaacagaaaacttacagaatgggagatacattctgcaaactatgcatctgacaaaggtctattatctttttttttctttttttgagacagagtctcactgtgtcgcccaggctggactgcagtggtgtgatctcagctcactgtaacctccacctctcaggttcaagtgatcctcccacctcagcctcccaagaagctgggaccacaggtatgtgccaccatgccaggctaaattttttttgtatttttagtagagatgaagtttcaccatttggccaggctgatcttgaactcctgacctcaagcaatctgccctcctcagcctcccaaagtgctgggattacagttgtcagccatcgcacccagccaaaggtctattatctagtatgtataagaaacttatacaagcttacaagaaaagaaaaagcaaccccattaaaaagtgggcaaggtacatgaacacttttctaaagaagacatacatgtggccaaaaaaatatgcaaaacgctcaacatcacctatcattagagaaatacaaatcaaaaccacaatcaaatgctatctcacaccagtcagaatggctattactaaaaagtcaaaaaataacagatgctagcaaggttgcagagaaaaaggaacttagacactgttggtgggagtgtaaattatttcaaccatgtggaaaacagcatggtgaatcctcaaagacctaaattcagaaataccatttgacccagcaatcctagtgctgggtatatatccaaaggaatataagtcattctatcataaagacacatgtatgtgtatgttcattgcagcactattcaccatagcaaagacaaggaatcaactcacatgtccatcaattggcagactgcataaagaaaatgtggtacatatacaccatggaatactctgcagccataaaaaagattgagatcatgtcctttgcagtaacatggatggagctggaggccattattcttagcaaactaacatggaacagaaagccaaatacttcatgttcttacttataagtggaagctaaatgaggaacacagatggacacatagagggaaacaatagacactggtgcctgctgaagagtagaggatgggaggaggaagaggattagggaaaataactaatgggtactaggcttaatacctgggtgacaaaataatctccaggaatagacttcatgtgtatcttttgaatagcctccagtttttgtgtaaaaatacccatgggggggctatgttcctggagcaatgcttcaggccccgtgacatgagcttaccctatgtaacaaacccgcacatgtacccctgaacttaaaagtttttttaaaaaggtcagatagtaactattttaggttaggtggatggtctctttccttgttgtatgaaagcaaccctagacaataaataaaggaactcacatggctgtgtttcaataacagtttatttagacatgttggggaaaaaaaagtcccaaagacctgaataaacatttctcaaaagaagacataagaatgttcaacataactagtcatcaaggaaattcaaatcaaaccccaatgagatacaatctcaggccagttagaatagctattattaaaaggacaaaaaataacactagcaaggatgtggagaaaggggaatgctcatacattgttggtgggaatataaagtcatacggtaaatatggaaaactgtatggaggtttctcaaaaaactaaaagtagaagtaccatatgatccagcaatcccaatgctggatatatagccccaaagaaaggaaatcaatatgttaaagaggtatctgtactcccatgtttattgcagcactgttcacaatagccaaaatccatattttgttaatgaacctaagtgttcattaacagatgaataaataaaaaaatgtggcatatgtgtgtgtatatacatgcacacatacaatggaatattattcagccacaaaaaaatgaaatcctgtcttttgcagcaatacagattgaactggaggtcactatgttaagtaaaataagctaggcacagaaagacaaatattgcatgttcttattcactaaaactgtggatctcatggaggtagaatggcggttaccagaggccggaaagagaataaggggcagtgaagagaagttggttaatgggtacaaaaatagttagatagaaaaagtaagttcaggtattagatagtacagtaggaaaattataattgacaataacttattatatgcttcaaatagctagaagtgaagaattgtagagtctccaacacaaaaaaggataaatatttgaggtgttggatattccaattaccctgatttgattattacatattgtttatgtatccaaatatcatatgtacccccaaaatatatataactatgatataccaattaataaacacacaaataaagaaaaaaataactgatagtaaaaagaatggtaggactttatggtaaaaagtctgcaaggtggagcttcccagtgattctcttttccacaattaggtttacttttcaatttaagggggaaaaaatctaggaatatagcttctggcccctgccctctcctcatttctcacaatgctgctgaaactattctttggttaagatgactgctcacttcctaatttccaaattgtcagtactcatccctctggacttcactggagtatctgtctttgctgatcactgtgctgaaatgctcccatttgctaggcttccagccacacttccctgactttcctcttactttgctcattgttctttttcaggttcctcttccttttctctcccagatgtgttttcttaaggttacgcctttgattcttttatttttattttgctctttagcaatctcatcccacatttatggttctaatcatcacatctatatgaatggtcaccataatctagtggtgacatctcaagttcttgtagttttattttctatcatctcaacctggatcttctggtagtaacttaaatatattcatttctgtcctaaagtgtccctttcttaattttgtttccaatttcttctaatataaccactattttcccaggtactaggctataaacctcaaattcattccctttcacctccatcatcacaatcatctaatttgttttcagtttctgatcaatttatattgtctatttgcaatttgtcccatcttaaaaattcttattcctacatctcttattcagatcctgacttctgcatgtaatattcaattatcttttagcaggtcatgcctctcccttttcccattcagttgacacagaattttcaaatcaatcttccgaaagcacagctgtgatgatgtcactctcctactcaaaacctgtagtacctgtagtaactaaaccaaatctatgaaactgatctaaaccccttcacttggcactaagggctacaacttacctttccacagactatgccctcccactggttcttaagtggggcaacatcactttactgggaggtttatggaaatgtgtgaaggcacttttggttattagaaagactggactgggggaggtggaagttgtgtcttagtgctgattctgagctttctggcctccccagaaaaggttgatccccaccactgtgactgtatcacacaacaaataattgttccacccaaaatccaagggtgcctcctgtaaagaaacaacgtggcttagacagactcaattgtttacttttttcaatttctattacatgtttttccatctccgttgcctagaatgcccttttcgtattttcccaaatgtgcaaatcttgcttctcctttaaggcccatggaaaatgacatttttctgtgggctctccctgtgtcccctgacatgaatccaattctcatgccatttccaccgattcctcccaaacaccacttcctttctatctggataataaattttcaattttgattataaacttaatgtcagcaaggctctacctttattttcctccgtgactagaagaacattgtacaggccagcacagatcctttatgttaatgtgcttaatatcacagcacacaccatgattataaatgaggctgtaaacactttggtttgtaattcattctgagattcttgccttggcctgcatgtgaaactatgctaattctaggctatgtactttaaagtcattatctaattttttaccccactttcccacttgagtttgatggccatgacttctcctccacaaattctgtttcttctgccaggacacaccacctccgattttccttctaataaaacttaggccttaaaattcttatttctcagaactgctccactgagtaccccctaaatccccactccctgcccctgcctcaccctagcttcatggatgctcccagtaggtggtccgtaagtatttgttgaatgaagagttccttggagtaggtggaagaaagtggctgtgtaattggaacaagatacagggcagtgataggacaaaggcacagacatttatttccagtcttagtagctgtgctcatagctgcacccacgcactctctccccacatagataccacaccatcactagaaagaaactggtactaaacttacatttgaaatcaccctagtcagtcttgaggatacaccactcaattattataagctttttaaaaataaaatcacctcatttaagtcttttttacattatgacgcgactgtttgtttccaaagtcttaagagcattttgtgccattccctgaagtgaaaagaaataaattaggcataaattataaaaggcctgatatggcttttacatgattcttaaagaatatggtcattttacattgaatatttgggtcctatattgtttagttgcaaacaaaacatccatcatcatcatcaacagtagatgaaagagaatatgtttgcttcccaaagcttgatacttagaaaattaagtgctttcagttcgcagatatgacaacttctctaccagaaaaacaaataaaaaacccatacaaataagcacatagctttccattttaaagagatagtctaatgctcttactgaagtgtgtgctaaatacatcataacttaatcagaacaagttgctgtttttacaaaatagtcctgtctatgcagagagagataatgccagtcacttcacatgacttgtacttcaacagacaaagtgtcatactgggactttttatcattttgattagaaattgggagtttctacactcccagaaaacaaagaaggaaggggaatagtaatggcttccagcatttacctgccaatgaatataatctgaaaaaggtcattgaggtataatcattcactcagcaaaaatgtactgagtacctactatgtgtcaagcattattcttaggatatatcagcggaacaaaaattcctatcctcatggagtttatggctttccatgctaaaatatgaatacaagtgatctccagtgcatgccctagcccaaatactttgttctttttatatttcacatgcttctctagggcaatcttgactttcttccctacttatcaacacactcaatatatatctcttttagaaattacagattttcagtaacaacttataaaaatattatctctttatacccaaccacatcactgaaaataaattaggtatctctggaagctgttttagccctgtcaggttattggatactacttggtgagagcaacagatagatataacaaagcaatactacatagtgactcaaactagaccgtgattggaaaacttgacttattttagaaccacatattttagaaccacatttctctcttgtgattttggaaaatctaagtacttaggagggtttgcctaattgaatgtgtattcaccacagggaaaataccctaggttttcatcatgatttttgttaattagtgaatcttatttatggaaagaacacttaagaggatctaattcttctacttctcaataatgaaattctctctccaatatttttgtcaaggtacaccctattttgcttttgtttaaacacttccagtaatgaggtgatagctcactatggcttaaaacaacttattctttttctgcctatcctttaaactatgggcccaggactcagcatgaaattcttgatgtggacattcctgtgccaagtatattgaaaatttccttctatttcacaagctaagtatcataaccattttattttatttttcatgtcatatgaataatgtgctagtgtcataacaaggtttgaaggaggcacgtatcacacgtgagcatgaaaatccaatgatcaaacttacactacaaaaagatcaattatttcaatgctataagtcagtccccatatcacgctactgacttatactgttaagtcacctaaattagtacttttaactttctggacttttcaggccacaaatatttttcaaagaagaaggagacacaggaaggagaaggaactgacatagggtgggtatatttttatttttttattagtaaagtaaaaaaatattttttattgattgataaataatttatttgttgccaaaaataaaaatgtaaaaaactattatctactttattatttcataaatcaaatatttctgataaatataaagtagtaaatataaaacctgagaatgaaaagttgaataaatttcactatatgaaaaaaagctaactacactgagctacttttgctatagaccatgaaaatgctttcatagatccaggtttgaaattcattgaacaagagagcaaatgtccctctcaactcctgatgacccatgtgcttttgatgtgcaatcgtttcactatatgctcgtgcaataggttgtatttaagctaaggccctgactttatatttgcccttatttaatttcagcttatgagttttcaaacattagaccattctacctttctcagttttgtgccttacacaaatataaaatgtttactttttcagtattcttccaagtcacttgttaaagtggagcaaggattaagccctatagatcgctttatccttccaccaggttgagtataactgttcacacacctgtagtactccagcaatcatccagatcacatttctctctttcataaaacagacagatccattagaggatctaaggattgggtttcaaaaggcttctagacccacttttcacccaagatttgtttgtgccccccacaaaataccttggtcaactagtcactctccttgtgttaaatgtctgcagtgttgagaaactccaaatcctgtgttctcaataaagtccaattcctgtcaggatagctctgttaaaaaactcttctctatattgagataaaatttgcattcttctaacatctgctcataggttgtattttgcccctcggggcccttcagaacaagtcattcacatcatagtcctttaaagatataatgagagtgattgtgttcctccaggtcttttcctggctaaaaattccctattgcttttctgaggtgttcatatgatatagtttcaactcatgtcactatttcaaatatctctgctaaatatgctccaagtgacaaatcttttttgaagggtgatacctataactgggcaaagctttacagtgtggtcctttgtacacagtaagaaccagaacaactcaattcactgaaacctacgtgaattcaattgtacttaacaaatagaaactcagggccaccctattagctcctcctgacccaggacttaactgactcactctaaaatcaatctagcctatgaattcagatctcatctttggtcagtatctatacataaaatagtcactgtaaaggatttttttctatcagttacagctcaaagtaattatactgtctttttttcatcttattaaaaataagacacaccatattaagaaaaatatcaagaagctgttgccaaaatcatccctgccctctatgaatatagaatgatttatcattctagcaaccttctcactgatttatacactgaacaaatatttattgaacatccaatatatattttatttctgctaggtacaggggatattaatggtgaataagggagatcaaatcactgacttcatgaactttctgtgtgagtgtgttatatataataaaggtaacaaattaatataaaatataacttcaggttgtgatatagactctaaaataaataaatatggtaacataataagtcacagctggaggagtgatttagggagaagggagattgatctctgagaagatgatatttaagctgagtcctcataaagtgaacataaaagaagttgtccaaactgaatccagcagcacatcaaaaagcttatccaccatgatcaagtgggcttcatcctgggatgcaaggctggttcaatatacgcaaatcaataaatgtaatccagcatataaacagaaccaaagacaaaaaccacatgattgtctcaatagatgcagaaaaggcctttgacaaaattcaacaactcttcatgctaaaaactctcaataaatcaggtattgatgggacgtatctcaaaataataagagctatctatgacaaacccacagccaatatcatactgaatgggcaaaatctggaagcattccctttgaaaactggcacaagacagggatgccctctctcaccactcctattcaacatagtgttggaagttctggccaaggcaattaggcaggagaaagaaataaagggtattcagttaggaaaagaggaagtcaaactgtccctgtttgcagatgacatgattgtatatctagaaaaccccactgtctcagcccaaaatctccttaagctgataagcaacttcagcaaagtctcaggatataaaaccaatgtacaaaaatcacaagcattcttatacaccaataacagacaaacagagagccaaatcatgagtgaactcccattcacaattgcttcaaagagaataaaataactaggaatccaacttacaagggacgtgaaggacctcttcaaggagaactacaaaccactgctcaaggaaataaaaaaggatacaaacaaatggaagaacattccatgctcatggataggaagaatcaatattgtgaaaatggcatactgcccaaggtaatttatagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacgctacctgacttcaaactatactacaaggctacagtaaccaaaacagcaaggtactggtaccaaaacagagatatagatcaatggaacagaacagagccctcagaaataacgctgcatatctataactatctgatctttgacaaacctgagaaaaacaagaaatggggaaaggattcccttttaataaatggtgctgggaaaacaggctagccataggtagaaagctgaaactggatcccttccttacaccttctacaaaaattaattcaagaaggattaaagacttaaacgttagacctaaaaccataaaaaccctagaagaaaacctaggcaatactattcaggacataggcatgggcaaggacttcatgtctaaaacacctaaagcaatggcaacaaaagccaaaattgacaaatgggatctaattaaactaaagagcttctgcacagcaaaagaaactaccatcagagtgaacaggcaacctacaaaatgggagaaaattttcacaacctactcatctgacaaagggctaatatccagaatctacaatgaactcaaacacatttacaagaaaaaaacaaacaaccccatcaaaaagtgggcgaaggatatgaacagacacttcccaaaagaagacatttatgcagccaacagacacatgaaaaaatgctcatcatcactggccatcagagaaatgcaaataaaaaccacaatgagataccatctcacaccagttagaatggcaatcattaaaatgtcaggaaacaacaggtgctggagaggatgtggagaaataggaacacttttacactgttggtgggactgtaaactagttcaaccattgtggaagtcagtgtggtgattcctcagggatctagaactagaaataccatttgacccagccatcccattactgggtatatacccaaaggactataaatcatgctgctataaagacacatgcacacgtatgtttattgcagcactattcacaatagcaaagacttggaacaaacccaaatgtccaacaacgatagactggattaagaaaatgtggcacatatacaccatggaatactatgcagccataaaaaatgatgagttcatgtcctttgtagggacgtggatgaagctggaaaccatcattctcagcaaactgtcgcaaggacaaaaaaaacaaacaccgcattttctcactcacaggtgggaattgaacaatgacaacacatggacacaggaaggggaacatcacactctggggactgttgtagggtggggggaggggggagggatagcattaggagatatacctaatgctaaatgacgagttaatgggtgcagcacaccagcatggcacatttatacatatgtaactaacctgcacattgtgcacatgtaccctaaaacttaaagtataataataataaaaacataaaaagtaaaaaataaaaaaaaagaagctgtccatatggccatatgtgaaaaaaacactggtgaattaccaagtgcaaacataatataatgtttatataaacttgtacatgtgtacgtgtatttatgtttataagtatatatgaacatgtgtatacaaatatatattagacaatggaaatatttataagtccttatgggatgtgtgtgaaacaatggtagaatttcacaataattgagaaaggatcaactatttaatatatgatggtggcccaaatgtcaacactactaaatgaaatgatctctacctcatgttagacataaaaatatatttcagagggaataaatatctgtatgttgaataataatactttactcttttaacaacataatgtgggaaatatgtgacaaatttgttgatagaatgtcttaacgaggtacaaaaccacaaaccaggacacccagtaggtgctccataactatatattaaaataattaaaagataaatcatatgtttaccttaaagttcttcaaatcttctgtgactgaaaaattatttaaaaaatatttcaaaagacatgggcaacagagatatttttaacaaacctaagcaaattaattacaaaatacaacctaacaaaaatcggaaaattggaaaacgatataagcaagtcaccgaattagaaagccaaatagtcaataaatatttgcaaaaagaatgttctcactaggaatcagaaaattacacattaaaaccaatgagagatacttaatcctcttcagattgaaaaggcattttaaaaagtgataaccttgagcattattcacaatgtgcagagatgaaaacacttaaagagtgttgatgggagtatatttcattcaactactttagagacctcattgcagtattctgttccctctggagtttcatagaaaattgacatcagttgggagatctcagctgcaggtcctctagatcccacttttccagcttgttcttacttgttaatcaacattaagtccaaagaagcagtttccttcacagtttccttaatattcttagagatgaaattgtcagcaaggcaaatcaataatttaacacatgccctactttttgtagactgagaatctcaggagacgtccagagacttaaagtccctaatctttgttatttttctcatccttataacatttgtggtctttattaggaagtatccgtattatatcctgcttcttctcagataagagtgtttaaaatttctctatgtgtatcttgattcatggcttcaaaaccatttgtcatgtagaaataattccctaaaagtgtgtcactcttcagattttaagaaacatctgaattaccgacaagaaaatatttcttaacttttttcaaaccgataccttctttgataaaagaaaaaaagagtcaattctttcagctgatttgaaatttcaaaataaataattactaaaaataaatcaaatcatttggacaaagcacctttgcctcaggagattccaatatggccacttaaagaatgtcagtctttttctctactctctttttaagaatcgccttaggacaattctgtcttccatgcttcaaataaacattttggctgggcacggtggctcacgcctgtaatcccaacagtttgggaggccgaggtgggcagatcacttgaggtcaggagttcgagaccagcctggccaacatggtgaaaccccatctctattaaaaatacagaaattagccaggcatggtggcgcatgcctgtaatcccagctactcaggaagcagaagttgcagtcagtcgagattgcgccactgcattccagcctgggcaacagagcgagacctggtctcaaaaaaaaaaaaagaaaaaaaaatagtgtattttcatatgcataaaagcattaggaattatatataattttacacacaaaaagtaacttagttgtcatacctgtggacacaaggtttccaaatgattggctgcaattttgacaattttaattccatcttcatttgttgacatggaacaagcaagatttgccaccttaaatacaatccaaaataatggaaattattttagattagcaaggaaatgcagcaacacttatactgaacaagaacatgtacacattcatcaagaatctcaatgacaaataacattctcaaaatcatcactggtatctattttatgaaagaattcagagaatctattaaagcaaataacaataaaaggacctagataattgtttaaaatgaggagagactagtgagagaatcagtaaaccctatacagtctcttggtatcaacatctaacccataataagaagctattgtgagactggaaaaacaaaagtttatctgtggattgaatgctaataggtttttggaatctcatatgattgtgatttattttaaatttgtaattggtttattatttcccagaggtctattactcatatttaagttgcattaagtatgactgtatctttatacattttgtttgcatcaaatatactacaaagctgaacaaatacaagataattaacttcttcctgctcttgattttccactacaacttcatgggcactgtttgacattcctgcagtgcatttgattcaagcattagtgacacccaaatttctcttatattattgcttttgaaatttacattttcttccaacaaaatgagtgctgttttaattaccattatgtccatgacctaaatccaaggtttacaaatactttcttcagaccatgaaagagccatgatgaagagtgagaggttattttcccttcctctgcaccccactcttgttcaagattcttcttactaacacagtaaggcttatggacagaggcaatgttttctctgatctacaaaatatctcattgtctttatcattgcaaggatttactttatctaacagtaatttttctaacttttaaaatatctctgtcagttgttttatactttaacgcattgcagtttttcctgctaagatctaaaatacatccagttgcggagaaactacgcattagccacatgcagtggaaataaacaacatatgactttggatcactattttaaaagtaccacaaaatgttatttaaatggatttacagtctttgcttttttataacatttcttttaatatgccaatagtgaaataactcctcggttttcattcacatataatgaaataacagccatacattatttaactgtggaagggcattgctcactttattaatgtacatggggatggcttacttgaaaaggtcttttgttggcttgaaggtcacaatgcctcaactttcataatttctgacacataattagcacatttgtgagttgtttgaaaagggcaacagtttctgtgcccctttccactccccaaaccccaatcactaaaagtgaaacttgacagtctaattgctttaatttgtattatattaattcacactgcatttgcaaaaaatactgacctgtaaaattgagcactgtttgtttaaagtaaaaaaataaaaataaaaataaaaatcattggctcaatgtggtcaaattagaagaatgctggttaacccaaagcttagaaattataaaaaactggccctatgtagatacttttttattttacttacttatatttactgtatcctcattttcttctttttccttttgaaagtatacattcttcttctggatatttgctggccaccgaggcttattaaaagccaattaagtgactgacatagtatagaaattatgttaaacacagtgtgtgtttatattagcagaattaattttatacaaccctctaatgaaaatacaacacaactgaaagttgtgttttctactcaaagttttctgctcagtcatcatactaacactctttttgtcttcatgtattctatgcctgcacatacttgaacttctccttaccagaactgttctgtcaaagttactaggtaatagagtatatttcaagtcatgtgcagttttagtgctattgtgtacaaacaaggtcgaattttaagataagtaatatctgtgacaaaacagaaaagtgttagaaataaaatatctttacatttcaaatttgaatgattttatgacatattttctaatgttacatcagtgtgtgaataaagccaaatttcttctaatgatgattcttcctaaattctgcatggctctttagtcaagtatgttcccaagaacagtagaaatgtaattccctgctggtcaaagaatacagcctgcaaataagatgttctgtaaaaatagttttagatatttggacatttgatatcctttgtgtatctgcgcaaaatgtgggcaaagctttgttggtattcataagatctctgtagaatgtttctgctcactgagggaaacaaggatatcgggagtttttggagacaaacagatttgggtttgaacccagttcctacagttaataagcttctgattatgagcaagatattaaattatttgatcttgttttgtcacctataaaatgagtatgataatgatgacctcactgggatgctttgagaattaaacgagataatgtatggggagagtctgaagcctggtggccctcaccatgtatgaattgccttccatttaatctatctctcaactaatggaaagaaaaagaaaagaaaaaaagaaatttcatactctcagaggttttgtagaattaaagccttaggagcctaaagaaatttaacaatatgtctgacccaagagccacaaactcaaatgctttcaagagccatgcaggggatgggatacaaacattgagtctagattgaactcagtagtaggctggggttgtgggtccccagacaaaatgattatgtatgccctactgaaaggcattcattaaaacgagagaaatgaaaggaaaaactcaatgtcttagccaaactaacagtctgttggcttactttagttcacaggtcaccattttgtgacatttaaccccactctctaatcttatattgtataaataagaaaacaaaattaagcagggggatgaaacatactcaaaccaaccaatggcagggcgactattaactagcaatatgtgtatgtcctttttgctaccctgaagaaagtcttgaaaagcattctggcattgaaatgattgaccagactttttattggtattttgctacatccttaaccaagtctacaaaaagcagaatctaaattatcttaaataaatgggacaaaaggtagttatttaaatttacacatttattgaaaagaaaaacctgggacaaaatgttctttcatttttatgaaagattaaattacatccttaaaataattaccaatattgtaataatttaaaaacaaacaagaagtcttcaaacagggatatgtgtcttgttatgagaggagagtgaagttttttattagcatccctctcttgcagctctttccttcccaccattccttctgccctctaaaatgtatggtatattctaggccctttaaacatggctgaccttattgccctatttgggctctaaaaaacattgtagatgagaatgcctagccagacaattcctcagctgaacaatcatgttaatgtttgttcccttccttctggttcctagttcaagttcattttatttacttatttatttagagaccaagtctcactaggtcgcccaggctggagtgcagtggctcgatctaggctcactgcaacctccacctcctgggctcaaatgatcctcccaccacagcccctcaagtagctgggactacaggtgcgcaccaccacacctggctaatttttgtattttttgtagagacggggtttcgccatgttggctaagctggttttgacctcctgacctcaagcaatccatctgcctcagtctcccaaagtgctaggattacagccatgtgccatggcactgacccctagttccagttctgtatactagttagtatgtttctgtcatgatttccatttgctggactttgagtcttttctttcactcagcagagaacatagtatccttcactccctaacccatggtttcaggtgagaaattccctgttgtggagcctggccttgtagaatcctgacacctaggctagttctgtccctcactctctatcaaggtcaggaggatgatcaggcttgaaacaaaaggatgagtcaccagtggtagagccagggacggcaatgaaacagatattttgagatggaaaattttttcaatgaccctttaaaaaagatctaccatactataggttaagtctgcttttcatcattactttgttctaatctggtaaagatattctattttaaataaattgaatatcagagcatggtatgttttaacgttctagtattaagttttatctgaaatctcaggggcactggtagtgttctcagtcatcttagaaaactgaaatgaaatcattgttaggaatgagtacactatttggacagctgcttatcacatatcattcagtctgtcaccaagaagttcccacacaggtatttacctgtaatatgatctctccagaacacgaagcaaaccttgatgtttgctgagattttcattgtcacacattcattgtttatatattgttcatatagttaattgtaatatcatgtcaccacgtctcctagctctcaatgggggagaaaggtcactgtctcattttcatgcattttcccatctggcaattggtcatgcaactcttgtgtaaatacttccagaggcagataatttattgtcttccagggcagtctagtcccattgcaggacagcccaaagttacaaagttacacaagttatgaagttcttctttataaggagatgaaatatttctctcaacaaatttctcctacttgttctagaatacagaatggcaaatatattcaataatggaaataaaatggggcctacaaaaaatccaaatcaatagtcctcaacttgtgggataagagagatggtaagagtaatagaatcaccagtaaatagctattaaaaagaaaagtccaattcccttctgtcaagatattctgatacattaagtgtgtatacgcatggaagacagaggtgtaaggactgtataattagattttttaaaagttctcccaggtgattctgatataccacctcccccatctccaacacatacacacacacaacaacaacaacaacaacaacaacaatacacacatgacaacacacagatacatactaggattttggttaattttcatgtgtttgaatagacagtctttcccgaagataaatgtactgaggtgaaagtctaaaaaagaatgacctgaacatgtgtgggttagcgtaggaagtttaatagaaagcttcacacattagaggcaagaaataatgacttaaacttctacttgagaaatagagaaaaggctaaaaattaaaataagaaaatcaagtataggggatattctggccttccatccaaaatccattcctccctttggtaataacactgatttccctcggagaacagttctttttctaacctagtggtgtaaagtcttggtacgactgtcaatcaaggatcctggtcctcccctaggtctagcctgggcatatcccttacttactagtgccacctacagccctgaatcactctttgttctgtcgaatcttagccttctttcattctgatttatgtgcattaccttatgtcttccataaagtctttatttctttttaagtaagccaaatttattttcctttgcatacaaccagagaaccacgattcttagtaagtactgagccagaaacttataccctaagaatgtactaatctcagatggatactttcaacaaagttgaaagctggtaatgtataaccataattatttctgtgaaaggcaacttctcattaaatgcctgcctctgggtttagtcagcctgcatgtcctagtgttaggaacaaatgtaaggaaggagacagtcatatcagttcctgcacatacagataagtgtcttcctttgacgatctaattcttcaatgtctattagaacatgttacatatcaggtacaagagaacatctaattcttgaagaaaataatttatcatttttgagtttatctttcagcaagctgctcattctgtttgaaaaccacccctcacatactctttgaaaatcatacctatacttcaaggcctggatcaaatattgtctcttccacaaactcttttcagatgcccaggatccatatctttatcttcccacactctcgcattatagcgaattctccttctctctaaactcatttatgtatctatcagatggtgagctgcttgagggtaaagacgatgatatattcttttaaaaatattttcccatcaagttaaataccccgaaaatagcatttcatctatgtaaataaataaaaataataatttatctctatctggaactgaatcattgttaatataaattattgtctattgtgtctgaaattaacacatttggtgaattctattttttaaagtcctgtgtacaacttaatttgttcgttggaagctgtgtcctttcttccactccttcctaataaaaatgatcctaattctgtaccgtatgaatataaaggtaagaattattgctttaggttatggggggaaacacctgagaaaagaaagtccttaggttattaaacttaactgccccgagtggatttcagtctgactgtgtatattcattggaaacatcaagattagacaaatctgtagcaaagatacaaataaacagagaaaaactttgaatatgggtgtggaaataatctagctgaaatgtgttatttatttttaacttgtattggcaaaggagacttgggcttctttctgaatttagaaataaatggcagttcataaaagcttgtgaagaagcatgaagaaggaaaaatggtgtctatgccccttggacacagtagtaagtagcaaaactacaaagtcactagccaaatcactgatagatggaacactagaagttcttcaggttggtaggagatagcaagagttgaatcagatactttgagtttgagttgccactgagatacataagaagacataaactacatatagttagatgtgtagttaagagggggtctacagtagagatattaattaagaagttactagtttattgatggtaattagatatgattatgtgaggagaaaaagttcttggaggtatataagatattaatatttattaggcagaaacatgaggttactccttcaatgagacttagaaaaagtggccagagataagaaaggttgcccacaatactgtgatgtcatggagaccaggagaagaaaaggtttcaagaggatgatatcatatatcaactgctgagaggtcaagtaagttatccctgaaaatatccagttcagccacagagacaaccatgctaatcattcctagagtgttcaagtcaaatgatgatggttaaactagtctgacatgaacagaggactgtgtatgaggtaaagtaaccccatgagtcttatgactcaaggcagagagctacaggtcgcctggataatactcactctctcattctcccatctatccattttaaaacattttacctctcagtaatatctcaaatcatgtattaggttggtgcaaaagtgattgtggtttttgcaatggcagaaactgcaattacttttgcaccaacctatatttttgctgtcctctaccctagttaagattttgatcagttttatttattttattcttgtttccagttttagcttttgttgtcagcaaatgttctttctctacaatatgttcacattgcagccaacaaattttttcagatgcaaatttggttcccccatcatcacctttccatccccacatcatacccccatccctactacgtcttgcagtctggcctgagagtcatcatgtgtagttcttgttctctctttgcttcagctatatcaatgtacttttatgtatcaatgcttgcttctgccagaaaacatctgtacatactgttctctgttggctggaatgctctcttcctcccttttcacagccaccttcacaccacttatacttgcttaactgctatccatcagatctctgctcaaaagtaattccttggaaagtttttcaccaacactgtcctccacctccacacagaatacctgaaacttctgcccacctaagtcagatttttccttcagagcatgattctcagtttataattatatgttcactgggaagattatttgattagcatacatttccccagatttataaaagcagggaccacccctgtatttgctcatcattcagcctacagtgccagtacctgacacacagtagacagtctataaatagttctttggggagtgaatgaatgcatgaatgcctgaatcagtatgcttgagaatgtatcatcttcttgatgaacatgagatgacaaatagaagaaaaatgggttttaagggaggagtcagcagcagaaattcaggacaagaaataaagaggaatgaaatttttcctttgaaattcattttcaatattctacaaaggcttagacaactggactttcaagaaaagtacttgtttttcttctagtctggccatcatccttaacaaggcttggggggcagcttctttcaagttttaccttcacttaagatatcaaatatggaactactgaataggtcccaatttagcttttaatttatttatttttaatcaagtaaagtaactcttaaagggcccaagctggatgccaaatgttggcaagtgtggcagatggaaagaggcacagtaacttccatagacaaatccaagagcttcattgtctatttcagaatgtaatatatgctctgcttctgataattgcagaaagagctctgatctccccatgttggcaccgaatgacctctggctaacaagtcagcccttctctttctcctagtgaagcagcgctgctctgcttcccttggtagtaataagaaatgattatgaattatgggttctgtagaatatttaactaatataactgtgctgtaaaagcacatagcaaattgcagggaaacaatttcatcaactaacaaatattgattatgcacctattatgtgggctgggaactgtcagggaaatgatagaagtcaaaatcaatgaaagtgaatcccaacaagcacaatctatttaaagggacacgtgaaaggatcaaaaactaaaactctgtctccaaatactacaagaagatagaggtaggtgaacttcatagagatgactgtagtaagagtgttacatggagacaaattattacttaggaaattcatattctcttgaactttgcatctcaagctgcttcccaaattttatgaatcctcaatcacacaatccggtctctgatattagttttgctttacctctctgtctttggtcatccatctataagatgaggaacagattgacttcatttctagacctctttccatttcaataattttgttttactgcttatgtaactgataacaaaattagacagaaattagacaaaggagaagagctatcaggcaacgttcctattaatttaaacatgaatttgtagatgaaatattagccaatttaattcaactgtgtaataaaaaataataataaagcaagacaatgttgtttattcccagaatgaacaaatgactcatgactgagagatctaatactgaaattcctttttgaactggatatcaatagatttttaaaaagcattgatgacaggtttatgcctattctgattaaagcaaagcaaaactacactaaaaaacaaactcaaaaccttagcaatctatgaataggaagaataattcttaatctcaaacaaaatccagaaatttccagcaagtgtcatgctcaaaattcaagattaagataagcattcccactataagtgaggttaatcaatattttactcaaggttctagtaaatctaaatgaataaaaaaaagcaatagatgcaaatattgttaacaaataactatatttattcccaggtctcaaaattgtctacctagggaaaacaagattatctgaaaactgttattactattgagtattcggtaacacttcttcatgcagaatgaatgtgagatgaataatatatttttctatatattttaaaagttttcatgacaaaatttgttattatagcaactaaatattataaatttcatagcagtatatatctattgaaataagcacaattatagatatgtgtgcatatctatagatgtattaaattttacttaatgatataaaaagagaatggaatgaatagtgagaaatatcagattcctggatggaaaaactcagtattgcaaaatataatgttatctctcataaaatttgtctattaaatttatagagctatactgaacttaggtaaattttaatgtgcatctggaagaatatatgaaaggctggcaaataagttttataaaaatggggaatgggctgggtacggtggctcacgtctgtaatcccggcactttgggaggctgaggtgggtgaatctcctgaggtcaagagtttgagaccagcctggccaacacggtgcaaccccatctctactaaaaaatacaaaaattagccgggcttggtggcgcatgcctgtaatcccagctacttgggaggccgaggcaggagaatcgcttgaacctgggaggcagaggttgaagtgagccgagatcacttcattgcattccagcctgggtgacaagaatgaaactccatctcaaaaaaaaaaaaaaaaaaaaagaatgaagaaaagtattatgtgccagtaattaaaaacacaaaaatttagtgtttttcagggtaatggtaaaaaatattggtgatggcccaatttcctgctctctactttcaggagaaaagtgcaattatgtaaaaaggctagaatatattactacataaaaaattttaaatgtcaaaatattgaaaataaagttaaaatacaaaagataggcaaaactttgtttttatatttgataataaaaattattatccacaggtataaatagctcctaagtatcaataaggaaaaaaggccattaaaaatggacaaaatatttaaatagagactttacatatgaaatatgactaataaatacatgaaaagattctcagtctagctcttactaagcaggatattcaactaagcaagaaaatcacggtttttgctcatcagatcagaaatatgtaaaaagtttttgatattatccaatactgctgagaatatggggatacaactggaaggtaaatggccaacttttcagagagcaatttagtttcacctacgaaaatttaaaatgttcagaactgtagcaattcaatttaatggaatctgtcattcagaaatacttgcatatgtgaacagactcacagccacgtgaaaactttatttgtaaaagcgaaaatgaatctaaatatttaacagtggagaataaattatgtaatattatgattctgtaaaaaaaataaaatgttatgctgctgtaaaatatctcaagtatataattttaagtgagatactgcagaatggaaaacatgattctatttaaaattatttacttacatgaccaggtgcagtggctcacgcctgtaatcccagcactttgggaggccaaggcgggcagatcacgaggtcaggagatcaagaccatcctggctaacatggtgaaaccccgtctctactaaaaatacaaaaaattagccgggtgtggtggcgggcacttgtagtcccagctacttgggaggctaaggcaggagaatggcgtgaacccagaaggcagagcttgcagtgagccgagatcctgccactgcactccagcctgggcaacagagcaagactccatctcaaaaaaaaaaattatttacttaaaattatgtataaatgcaaagtataatgtccacagtgataattcctactgttaatttgagttatatatgggagagaaggtaggattactattgctatgaagagaagtatccccttttgactatgtttctatatcgactgaagtttttccaagtatatttttcactatattaacagtgaaattagttttctaatttacaaaaaaacgcgattgatgaaatagtcctatatgtattggtgtatatggaacacaccaatgacaagtaaaacagcatgtgtaataatctcatttatgaaagatggtaaggttttgtgtatgcatatggaaatgtgatatccaaaatgatcctccccaaaatggcaattgtgatgatctctgaggagtgaaaatcaaggtaatttcaactttccttttctatattcttaataatttataatttggcttattataataaaaatgaatcattttgaagagaataaaacctatctatacctgtatgtgaatttttaataccaatcaagaaaattgtattaatcatgacacttattgcgaagcctgaagatacagaaccatttataaataaggtttccagaaaatacacatatataatgattacatagaaaaaaatgctgctaagcagaaaatagttttcatggtctcatatgctgttatatttaaaatgatgattcacaaaaatgattgagaattcacagtagggaaacaaggcactggttttaccttgtcttaatgtcaaataatggcacaaaaacaagtcaattaaagcttcttatcaatgacaaaatcataccagccaatattgatcttaataatgaatttaaattcaacatgtttggaaaggtactctgtgcatggtgtgtgtgtgtgtgtgtgtgtgtgtgtgtgtgtgtctgcagcagatataaggtaatgattcttatgattgaataattataacatggtcctacatttcttcctttttcctatcttactcacacctccaattctattcaaatttgtgtctgaaattcttgtccctctcaaataagtcattaaagatgaaaatattcatttgtctaagtggacatatgtcaacattgttctgaaaaagaggtatcagtatgctgcgtcagaatgtgccatcacaaaagaagcaattgagatgaaaacacacatacacacaaactcaaacatatttggctgttacagtattattgcttccaataaattatgagaaatatatgttacatagctcaaattgaagtctgcaatgtagactgctctaagagtcccattttgccaaatatatttcccttttagtttggaacaatatataactgtaaatggacacacacacctcatattgctgtgtgatgtaaattataatggtaaaaccagctagatagtttattcaaggtccctctctaaattaagctattattcacctcagaatcaccactcaaaggataaaagtatgtgtcacctgcctagtaaatttaatataataaacagtaccaaataaaatatattgaagtaccaaagagatgaaacaaatctaaactataaattaaagacaggattaagtgttgtttcctaaactagtgttattctttgttgtcactgaggtcaagaataaatatgaagcatgcaggtctaataagtgtttattaataggatcattgtggaaagggtagatgtcaaaacaatgctataattagctttcattatcattgaaattgctgtcaaatttcaaagcaattttatgaccagtgacctgatttctcacatggcagaaagagaagggattttcttaaagagagatacaatatattaaagccaatataaagttttcagtgagtctatttctgaatcaacatgttttgtacatattgcactgttcaaatgctatcatgggaacagaaggtgttgcataggacaaagttaattgaattgcaattgtgtaaacttcctggatgtggatgagaccatcaatatcacctgattccctaactaatcacgaaatacacacccagattcattccttactttcacaaaagaacgggtctcttagtagaatgacagtaggcaatcaatcatctggcaacttctatcttcgaagacatcataacaataatctgtgaaactatttttttcctgtaggcatctatttattatgactttgaaggaaataggcaaagaagctttgaaatttaccataattataatcccagagaaagccccttgtctctgagtataaattgccgataatgagtgaaacaaattggaagaacactgtgtgtgtgtgtgtgtgtgtgtgtgtgtgtgtgtgtgtgtgtgtggagtggaagagaggcaagcacatttgtgtatgtatatatgaagtccgagcaaaatttacaaatatgtgcatgtactattattaaatactatgatttcatatcccctcattcttgggtccctgaatctcaggagggctccttgaatgtgttctgcatttaattatatgataaaaatgaagtatagctaattatgtaatatagaattaaaagaaaataaaatatttaggccctttaacgttagcaggggcataagctattacaggtttaatcttaactacccctgtacctctacagcacactgaaatactggacacatactgtgagtagtggccattactagaggataggataagacacttgcagtgtaatcttagtaatttttttaaatatatattatttatggttcctagtagttctagaagggaggagggaggagtaagaagggatcttgtatactaaccttccataattagagcaaaccaacatatgaattctatttgcacaaggttaaattgtgaaatccttgaagacagaaaccatcttactcctctttttggttctaagatattgcaagcagtgggttcttaaagcttctgttgaatacatttaacccaacattgcaaataaaatatttttcacgttgtcttctctatacttatttatgattgatctctttacagaggcctaaagacaacaacaaaatccacaaatatttattatctatcaggcatgttccaggcactgaaagaaaaagaagagaagatggggaaaaagtagttgccatgcttcaataaatgagagatttagatgtaaatacacaaaacatttagagctattaataatgaaaacatttaaatgacagtgtatactatgctaaacgagtaaaacactaaatgctgatgggcttcataataaggagataacgcagtgaagctttaaaaaatgttagctggatagttttaaaaagtcttaaagaaagacaatttctatatatcaattgaattgtttaataaaactctaaaaataagactgtcatataaaaatgtgttgatagaaaacatagaagttttaatattaataaatcccagtaacagaagatttttggataaatcagaaatgtttcgtttaaatacaaattctctttaagaaatagtgaatggtctaatgaaaactgttattgcaaatactgaaagttacattgcatgttattttatttctatccttattacaatacttcctatgtatttagttgttttcaattcttatgtcaagtaacatgaaacttaaatcaaaattcaagaaagcaatgctgcattcaaggtagctccatgcacatcagccacatggcactacatggttgcaccagccaggcctggattctcaccagcattgctcaaaggctctgagtctgagtcacaggagttggagggcatttgccatcaactagtccagtttttgaccctgtttcagaaggctggcttgcttgcactgcacctggagcctttcaaaccgttgtcaggctcagcctctgaagaaagaaatcccacagcattctggctttgctcagtgtatgccgttttgttccagaagtcaggagacaggttgcttccttccccagctcttgagggcagaggctgagctttctcacctatgagatggtaaccttaatgagcacctcccccttgggacacagagtacaaagcgtcctggatgctcagtagccagaaacagagaatgccaataaaagcccagttcatttttcatcacagaagttagagtcctaccctcaccttcagcctctgactactatggatccctcctgcccctggctgccagtctttggaaagcacacccacaccttgttggttaattaacactaatgggcagctgccatccctgcataaaaccacaaccatggctggattacttgagggctgattatgctgtttgtccaggcacaatgtttctcttccctaacagcctaccctttggaccctgatggctcattatcaccttccaccactggaagaacaagacaagactgtcagctgcgtcacttctcacatttccaagaaaaagcttaaatctaagcaatgccattctaggcgttctctgcaagggtttttagcttagcaaaatccctcttgcaatctttgttcatgattttgtctcaaattctgaattatcttattaagaactggaaactgttcctgcaagtgacttgtttttaaatttgcttttcagacatctctaagggttgctggcaactcaagtgcaattcgtgatttcctctttcccagcacattctatttagcctattaatttcaaatgaatgtattttccctgcatcctctagaagcggactttaattgaatataatatcctcccgccgccgcccacccctccgccgccccaactctagaagtggacttctgggcgggggcaggcaattatattcaattgatattaataggcttaatctattcacttgaaattaataggctaaaatctgttgctctttcttttcccataaatagactaatgccagtccctgctgtcttcctccattcatcttccacatcctcttttttcaaggcccacaccatcatcttcccttctctgaaactgaattcagtctctacataatcaatgtactgctgtgatcacagctggtactttctggtatctccaggaatcacagttgacctacctttgttgatttctgggctctgaactatcattcttttctcttttctcccccgcccattcgttattcttgtcacatagtttctttcccttcccactagttatcccatcttgtagaatacaaaatccctcatacttttcctctcattctgcctttttcacatcactgtctctgtggtaaataaaacataacaaacaatatgttttttttaatctttgcactttaaacatatatttatgtgcagagaaataaaaatatatttctctgttggtgaataattcatttcctgttgctttggaaatagagtctgtgagccaggggctagttttatatctacgtttagtaaattgaatagaatattttgctataatgcagtaagtgtacctgaaatcactgttttgggagccacaaattcatgagggaaaagcctcaaaggctatggtacattagttgaaccatagaaaaagaaatcaattataattgcttctccagttaaatattatgagttacagtgagtatttaagatagttttgaaaaaaacattttattatttcaagatctgcatcctagttacagtggccatttttattagtgggtccaataaagtattcgtatttatccttgctctgttagcaggtgctgatgaagtagaggttgcgctatgaatataggaagcagtatgatttgaaaaaaggagaaatggcagtataggtattggaatccagacagaatgaactttatttactgttatcttatattttactcatcttccatgaagatgactaacccaaagggattcatatttgtggtcccctcaaatatgtccagttagtggaaacacatcacatattttagagtatgactcaataatataactttaaatccttctaactctccactctttcatattctccagtaaaaagataaaacttgaagtatttatttagaagtcactatgcaacactgtgctttgggagttcataactaccttaaaaagacataatctgtaacaagaatcattctaatactgtgtgtccttttatgtttaaataagtatgcatgtaaagctaaaataacatgaataaatttaccaagtcaaagattttacttcatatatgtcacttttaattcattactgtagtcattttaaatccctaggtaagtttaaaaaaaagacttgtttctcttctacaattatactacggatgaactgtgcacctctctctctctctctgtctgtatagctacatacatgcagatatattttactttaagtgttcagaaatcttattatttcaaaaggaatatgtgcttaattaaaagttttggaaaacactgttaaatacaaaagagtaaatacacaaaatacacattttcagtgtggcagataaactcacccaatgcctactctcaactcctctttcctgtgtcttttctcccctctattgcatatcacagagctctggccatatctcctcttcatattggatacatccatctttcagctgctggggataactgctattgaccactcatggcatagtcgttcactaggaactgtcctaggttgtaggaaactaccttccccaaggcaatgtctcttcccaggggaagctcacaattaatgatggagtgagttgggattacaaaggcataggtcccttgcctctacatgtgacaattctgaaaggtcacctgagctccagagtccctaagagttcaggtaaggtttcagttgcaaccacattcattgtaagtcagctgctgcttctacccaattctacctttctcccttcattacaggcttatctctgaagattactccccagtaaatcttcaggatagaactatccgtatcaaagtatacttacggggagccaacttaagaaaatcataatacccagcaaacagaatactcattttttcggtctcctttattgctaggctgaaccatgtgccaatgagattaggcacagttccccagggaagaatttttccccccaccattagtagtcaagattcactagaatatattcctttgactttttcccctttgttctcctcccaactgggatgcagacaaaataccaagagggcagacataatcttaaaactataaagataaaagcgaacaaacataccaagcatccaaaagatccttggaaacatcattgagcaaatgaacgcatgctagcaatcaccaacccctcaactttttgacatgggagaaaaaaacaaaaatcatttttaaattgattgttatttgcagccaaatgcaatcccaagtgatacaattaaggaaccactctatctagaagtatatgtatatatgtagtagagtgttgtttataacagcaaaaaaatgaaactgtcatataagtgttaagttatggcctatccttaggaaggaaaattatagtcattgcaataattcctttgaaaaatgaagttgttgagaaatgctttttatgccatattaaatttaaagatataaattccaacacacatagatataactacatatagccaatgaagccaccaatcttgtgacacttctttgtagaaaaagaaatttccatgttgtagcatattgcattttctaaaaatggccagactaatattatgtctcaacccacataatctccctaaaatgggtctacactctttccattgaatctgggtaagggcttgtgactgctcctaacccacagaaactataagagataataaatgattgttgtcttaagtcaccacattttgggatgatttattatgcaccattagatgacaggaacagctgtgtgttatctttgttatttgatcttttgaaatatagtttaacttggaaactgaagacaagtttattcctttatttaaaacatatttaatatgtgcttactgctctttttcattgtgataaaaaactttcattgagagagaaacatctcttaatattagtttgtcaggtgttagaatccaggacccctgccctggaattgttcatgagtccaagcagttgtaactgcatctagcaaataatggtctgctttgctgtctccttgttaaaagtacttcaaaatgtatgcaaaatatgtcttatagccagcaggcttctcattccttgctagggactctgtaaatgaaaaacaaaacaaaaaacccaaagctacagcagaacacatttgaaattatgaatacaaccataaaaatggcaattctaaggtaaggtttgagaatacagaacttatctgagcctgttgccttcttctgtgcaaaagaaccattatagataaacaggcagcagatagtcacaattcaatgccatgatatgtggataaaacgaaacaaaggtcgagaaattagcttacttccagatgttctttgggtcaggctcatctatccctaacttctcatatgaaagttaaactgccacagcctgaaataatagataattgaaattctcattttcttcagaaaattctgcaattaaaatgttgatatttctttaaaatacacacacacacacacacacacaaacacacacacacacacacacacacacaaaacctgatatcaaatcttacattccctccacccagaaaacatgactaggtcatttaaacagtacttgaatatattcacagaaaatcagcaggtcaggtagaaaattactcaccctacacaccagttgtgtgagtgttgcagagtatgaaccgctgccaagatatctgtcattggcatatctccacttttcaatttgatacaatgtgtttaacctatcactgttattcagtgtactataactgctatacaagcacctgtgtgtttaccagagctttactattcccttggctagaaatatttccaaacaaggtactaaatataaatgcccgccattttcaaaaatatatatatataataaacattctccaaatattttaaaagcctacagttaccaataagcttttgtgtacataaattagagaataaggggcaaagaaaactttattagcataccattaagtacttaatttattatttttgcagtgacatccttgcaggatttcttctttaacatgaaaaagtcaacatcttaactgttgaaggctctgctttagaatcctaggggcatttccagacaagttctagcgattattgtgaaagtacctgtttctagaccaactctttaagcagaccactaaaaagaccttttcaaatcttccatgtaaaggaaagccttgaaagggagagagctagatagatacatagatacacatatatagatagatgatggagatagatacagagaggtcagatgataacaaagatcagattataacaaacttaaatgtaggtgctccagctagctaacagagaataacaaatcatcacacagtttagtgacttaaaacaattatcacataatttacaatctaaacttgtaaatcttgtcaacagcaatcaggagtccacattatcctttaaaccaaattttatttccaagtagaaaatattttcttatttaattgtatactgatctgaattcaatgtatcttgtacatgaaaatagcaacttggctctgctgggtaactgaagaccatgtttgtgactggaagcatgttattaatctacttaaaatcttcattccttaataaaatctactccctgtcaacatttattttagaaactgaaatctttgtgagcatagctatattggcatcataagctctaaatggaagactacttaagggcatcttcttatttctagtagagttaatatcattactaaccccaactattctgatgaaataggtatctagcataaacatcaatcatcttcttttataactcattgataattccccatggtcccttgctctatttttcatctgttgtaacacataaaggggttcaacaactactttattctaagctttctctgctgcaaaccgaaggttactaattcacttcattaacaattacaagtatttgtatctgtcctcacaaattcaaaattgaccattttataaaagacatatcccttctcttcattctacctttgttaggtatatttttctatttccaaatatttattttatttccaaatcatgattcattcaaataagttttacacaaagaagaaagtacaagatgtgtaacagctctagtagagaacatttcagctgtgccacaaaaagaaaacagcaatataatggtgtgctgacaaaataggccaggcatggaggctcatgcctataatcccagcactttcagagaccaagacaggcagatcacttgagcctgggagttcgagaccagcctgggcaatatgacaagcccccgtctctgcaaaaaatacaaaaattagccaggcatggtggcacatgcctgtagtcctagctacttggcggggttaaggtgggaggattggttgagcttgggaggttgaggcttcagtaagccatgatcatgctactgcacactagcctgagtgacggaataagagacttggtctctctgtctgtctgtctgtctgtctgtctgtctgtctctctctctctctatatatatatatatataaaataatactttacatatattatatatattttacatatagtatattttacatgtgtattttatattttacatatatatattttgagaccaagtctcttacttgatccaaacccccagatcccccccaaatatgtatatatatatatatgtttatatatatatatacacacatacacaatatattagacactatgtaaatgtctgaaataaattttagttgggttctttattgagataattacaaattcacatgcagttgtaagaaataatatagagacatcccttgcaaactttatccccgtcttacaaaatgttaccacatcatccccctgtggtaacattttgtaagactatattttcagggtcttgacactgatataactcactgatcttatttttctccagttttacttgtattaatttttcttagtgtggtatgggtgggtgtgcaataagtctatacaattttgtcacctgtgtaggttcatggattcaccaccgcagtcaagatgttgaacagttcccacaccacaagagtattcatgttgcctttttataactatatccatctccctccttcaaaatcccacatcctcctgctagctcagtgcccccacacaaccactaactattccccatttctaaattttattatttcaaaatgttttataagtggaattatatagtatgtaatcttttgggatttttttcataacataattcttggagatttattcaacctaaggtgtttatcaacagtttattcctttttattgctgagtagtattccatggtatatatgtacaatacaaatatgttctcccattctttagcttgtaattttattctcacatggttttcacaaagttagcattttacattttgatgaagtctaattcatcaattttttaaattcacacttcatgattgtggtatcaaggactctgcctagccctagatcccgaatattttttcctattttgttctaaacattttgtatttatattataattttttaatattttacctttgtctctgatccattttgagtttatttttgtgtacagtgtgagacttcgttcggaactcattttgctgcctataggtgtcaaattgctccaacaccatttgtggaaaatgctgtctttcttctattaaattggttttgcatctttgtcaaaaatgtgttgaatatacagatttttgtgtggggatatttatgggtcccctattccagggctccccaacccctgggccacagacaactaccagtctgtggcctatcagcaaccaagccacacagcaggattggtgagtgaactttactgcctgatctttgccttctgtcagatcagcggtggcattagattctcatacgagctccaaccctattgtgaacagcacatgcaagaaatctaggttgcacgtcctttatgagaatctaatgcctgatgatctgaggtggcacagtttcatcttgaaaacacccctgcctccactcactatccgtggaaaaattgtcttccatgaaactggtccctggtcccaaaaaggttggggatcgctgccctattctgttccattgatctatgtgtctatgctctggcaatgtcacaccactttgattattgcagctatagtgtaaaacttaatatcaggtagagtacttttccccactttatttacctctttttattatttaactatttttgctattcattgtaaatttagaccacatgcatttatatttccaaaaacttgccaggattttgaagaaattgcatataaatccttttgggaactataatgaaattaaagaaagaaacagaaatgttctaggataacagagcaaaggcagataaagttctggcattggaggaagactaataaactaatacaatatgaaaaaaattgatgtgaaaaaatagaatatccacttgaaccatacatgcggacgtgtggataggcatcagcattccagcacaacggatgggacagaaacaaaaaatgagattatagcacaaagagttaactttaactatgtagtcatcacagaatgttatgggagcaaaacaataactcagtcacagcaatagaagtgtcaattttattataatagtgctgaccttttttggggcaagtggaaggggtagggagtagaagactgtcaataaagacatgtctgtatggaaatacagacatcttttgttggtaatctgctaaaaccacatacttttaaaggtgaaagagagatgaaaatacattatgttattaaggtatactctaaattgccaggcaagattgagaaaagtgatgaggcttccctgatagagactccacaattagaaccaaagcagtacagagcagcaacctgagcttccatcattcactcactgggattcccatcaacatacagcatccttggcaagtcttgttcagatggaaaagcagtcacaagaggagtgctcttctaatcctgtgctaaccaatctaaaagcatttgtgactgaagtagtggaaactctgaacaaaattaccttgtaaattttagtttatagtagcccagatatgtggccatgctagattccaaaaacttcagagaaaaatgggtataattaatgacctcttattctgacactttgagagggtttgaaggctatcaataataattctgtgatctcaagcaaaaaagaaaaaaaaaaagaaaaagaatgcggctgcacctcagactccatgagaagcttatatgtaaatggacaaaattcagaagaaataagtgcctcgcacaggccttaacacacaagttgtgctcaatcatgtttggtaaaagaatgaatggacattgtaaaaccaaaaattaacatctaaagggttcatacactacaagccaggagagtcaaagtatatatcatctgttcatctaatcattccatcattaatttattatgagcttcttgctttcagggtcccatagtccagagtgaaaaagtgatatgcaaaccaaaaaatcaaaatacaggaaagtaactatgactaggtaattgtttaaaatactttgggaacaggcaggctggagttattaattaactatatttggggaaaagaagactacaaaagtcttcacaatgtagttaacatttaagtaattttgaagaatagcagagatagagagttataaaaattactcttttttttttttttcttgagacagagtcttgctctgtcgcctaggctggagtgcagtggtgtgaccttggctcactgcaagctccgcctcctgggttcaggccattctcctgcctcagcctcccgagtagctgggactacaggcacctgccaccacgcccagctaaattttttttttttttgtatttttagtagagagggcatttcaccttgttagccaggatggtctcgatcttctgacctcgtgatccacccgccttggtctccccaagtactgggattacaggcgtgagccaccgtgcccagccaaaaagaactctttatatatgtttttgaaaagaagaagaaaagagaagcatatgctatcaaaaaagaaattcagtgctggaatgataatgagctcagagcaaaagtaaagagataaactgcctatagattgtttggagagcttaagttgaaccctccctagccattcccaaagatgcaagccccctataaaaatttggagcacctaacactacaaagtttgaaagaatattatctttgatatgattcctccctgtctgttaacttccatgtttccatcccattggccctgcttttatgtatcctccattggcctaacagctctcaaccagaggttttaaaccctgacagctcattagcatcaccagaagaacttttacaaaagccttccacttgtgtcccttccccagggattctgattccactggtttggggtaagggaccctgtgttgcccacagcggctgatgcccatcaaaagggcattaggaaaatcactctgcgggaaatcactctggcccgccatggtgaatgagtgtttttaagaggattaaacaaacatcaaaaagaaaaaaattaatgtcatggagttccataccatcttaagacttaatgattcatatgccattacacagaaggaatttgcccaagatagctatgaattgtagccatgatctctaaaaaagagtcgaatatgcgaatcctacctaaagaccggggacaagtgatccttaattcatacaaacagtaatggggagacactaaaatgttttctgaagaacattgacaaattaagatttgcacattataagaaatattctagctacatacaagaaaaaatgattgtaaaaaaatcaaagatgattcccagacttttgtttgggaaaccagatgaacataaatacaattcatcgagaggtaatggagaaaaaagtacaggcgtggcagcggaattagatgaggacagaagttctcctttagatatgctgatttttgggtatatatattacatagtggtttatacacaggttggaaattcaggagaaaaatcattacagatgggagatgtgtatttgagatccatctgcatatagctgggttgttaaggcaaagaaatagataagcttgttctgggagggtgtgtagaattctctttaggagaagaatacctagggcagaatttaaaggaacgctaacataggcagtagaaaaacacccacaaagtagattcataggaaatggccagagaggtagaaggaaaatcaggagagtgtggcataataggtgccagaagaaaagagtgtttaaaggaggaatgattgaacaatacttgcaaacattgcaatgatttcagtggagaatgcgactgaagtttgattagagtgaattaaggagtagatgggaggtaaaataaaaagtagaaataagaattagaaaaggtttataaagatggtggaagagaactttccagtgcttatccccacagagaaacattaatttgaacaaatatccatgcacaaacaaaagttcacaagagctaaagaaaccatgtgagagattacagaagctgagtggagcacagaaataagaaagacacactgataaaggtaagaaggacagttttaaatcacctgtgaagccgcttcacaaactgtatacagcacggacacagacagcagcaatacccaacccttacgggaaggaaagtgagcaccaaacttactgtggaacccaacactgggcctgctccagcaaaacccaacttcacgcaggcacctatggccccagactccaggctgatacctgcagactaagcttccaggcccacctggattctaggatagctcccacagccctgggatccatgcctgctcaatagactcaatctctgggcctgccccactgccaggctgaccccagcagccctaggctcgggaacagccccagtatcaggcaagccctaccagccctggcccttggtcagaaccagacatcacagatgtaggcataagcctgacccaggaccaggcctgacacaggccagcaccttgggacccagcctccaggttaagccccacagactcgggcttcaggcttaccccaggtttcagacaagccggaagctaaaacatcccatgcagtcccaggcctcaggccccaacaccagattagcactcctggtctcaatagcaggggactcaaatatcccactttcagcaatgaaaaaattatccagaaaaaatatcaataagtaaacatcagattaaaactacactttagaccaaatagacccaacagacatatacagaacattcccattaagcagcagcagaatatacttttttctcaaacacacacagaacattcttcagggtagatcatatgttaggtcattcacaagagcttaagaacccatgtgggagattacagaacccgggtgtagcacagaaatattggcaaaacaagtcttaacaaatttgaaaagatgtaatcatattaagtattttttctgatcataatggtaagaaattagaaatcagttaactggaaaaatttcaaaaacttcacaaatatatgaaacttaaacaatatgctctttaacaaccaacgaatcaaagaagaaagtaaaagagaaattaaaaactattttgagataagtgaaaagagagacacaaaacagcaaaactcatgatgtgtccggaattggtgggttcttggtctcgctgacttcaagaatgaagccgcggaccctcacgatgaatgttacagtttttaaagatggtgtgtccggagttcattccttcagatgttcagatgtgtccagagtttattccttctggtgggttcgtggtctcgctggcttcaggaatgaagctgcagaccttcctggtgagtgtcacagctcttaaaggcggcgcatctggagttgttccttcctcccgtccagagttgttcatccctcctggtgggtttgtggtctcgctggcttcaggagtgaagctgcagaccttcacagtgagtgttacagctcataaaggcggtgcagacccaaagcagacccaaagcttccacaaagaacaaggcttccacagcctggaaggaaaccccaacacgttgccaccgctggctcgggcagcctccttttattcccttatctgaccccacccacatcctgttgattggcccattttacagagagctgattggtctgttttcacagggtgctgattggtgcatttacaatcctttagctagacacaaaagttctggaagtccccactagattagctagacacagagcactgattggtacatttacaaaccgtgagctagacaaagagtgctgatcagtgtgtttacaatcctttagctagacacagagtgctgattggtgcatttaaaatcctctagctagacataaaagttctccaagtccccaccagattagctagatatggagtgctgattggtgcatccacaaaccctgagctagaagcagagtgctgattgggtgcatatacaatcctccagctagacaaaaaagttctccaagtccccacctgactcaggagcccagctggcttcctctagtggatcacgtgcaggatccctgggctgagctgcctgccagtcccacaccaagtgccgcactcctcagcccttggggggtcaatgggactgggcgccgcagagaagggggcagcgcccatcggggaggctcgggccttgcgtggggaggggggttggggggcagtgctcctgcatggcaggctaagggtcccaagccctgccctgctgggagacggctgaggccctgagagaattccagcgcagtgcccgccggccggcactgctgggggacccagcgcaccctctgcacctgctggcccgggtgctaagcccctcactgctcggggcctgctgtgctggcctgcggctccgagtgcggggccagccaagcccacgcccacccagaacccgcattggccggttcccacccgcgcctctccctctacacctccccacaaggaaagggagccggctcctgcctcggccagcccagagaggggctcccacagtgcaacggctaaaaggctcctcaaatggtggccagagtagatgccaaggccaaggaggcaccgagagcgagcaagggctgctagcacgttgtcacctctcaatgagatgcagcaaaagcagttctaagatagaagtttatagcaatagacacccataataaaaaggaagatcccaaataaacaaatgttacacctcaaggaactaaaaaaaaaaaaaaaaaaaaaactaagcccaaagttagcagaagaaaggaaataataaaaatcagagcagaaataaatgaaatagtgactgagaaaatgatagaaaaaaaatcaacaaaagtggctttttggaagttaatcaaaatggacaaatctttaagtagactaataaaaaagagaaagactcaaataacattatgaatgaaggaggggacattacaactgataccacagtaatgcaaaagagtataagacactattatgaataattatatttcaataattgaataacctagaagaaatgggtaaatttctagagatatcacccacccagattgaatcaaaagaaagagaaaatccaaacaaactcataatgagtaagaagattaaatcagtaataaaaagtctccaatcaaagaaaacccaggaccagatggcttcactgcttaattttatcaaacatttaaagaagaattaattccaatccttctcaaactcttctgaaaaacattgaagaagaaatacttccaaactaatttcatgaggttagcattaccaccataccaaatccataaaaggacactacaaaaaaataaaattacatgccaatattcctggtgaacatagatacaaatatcctcaacaaaatactagcaaaccaaattcatcagtatatttaaaggaacatttatcatgatcaagtaggatttattccagagatgcaggtatggttgaatataagctaatctagaaatgtgatacaccacattaacagaataaaggacagaaaaatatgatcatgtccatggatgaaaaaagcatttaacaaaattcaatatccttttgcaataaaaattatcaaaaaattagatatacaaggaacataccttaacacagtaaattccatatatgacaaatccatggctaatatcatactggatgcctctaagattaggaataagacaaggattcccgttcttttcggttctgtctaactaaagtgctgtaagtcccagccagagcaattaggcaaaagaaaaataaatggcatccagattggaaaagaggaagtcaaattgcccctctttgcagatcacatgatcttataaatagaaaaaattagtgacctcactaaactactcttaaaactgatacattcagaaagttgcaggatacaacatcaacatacaaaaatcagtagtatttctacagactaacaacaaactctccaaaaaagaaatcaagaaaactatcccatttataatagctacaaaagcaataaaatacgcagaaataaatttaaacgaggtaaaagacctgtggattgaaaactctgatacattgataaaagaaattgaagaagacacaagtagagttatcccatgttcaatgattaaaagagtttatattgtttaaaatgtctgtattattccaagcaatctacatattcaatgtaatctgtattaaaatgccaatgtcacttttcatagcaatagaaaaaaaatcctaaaattcatatgcaagcacaaaagatgctgaatagccaaagcaatcttgagccaaaataacacaatcagaggtatcacattctccaatttcaaaatatactacaaagctatagtaatcaaaacagtgtggtactggcataaaaacgtacacaaagaccaatggaatggaatagacagtccaaaaatgaacccatgtatatatgatcaactaatctctgatgagggtgccaagaatagaaaatgtggaaaagataagtctcttcaataaattttgttggggaaaatggatatctacatgcagaagatgaaattagacccttttcacacaccatatgtaaaaatcaactcaaaatggattaaagatgtaaatcaagcaatacctgaaactgtaaaactgctagaagaaaacatagaggaaaatctccatgacataagtctgggcaatgattttttggatatgatctcaaaagaaaaggcaacaaaagtgaaaatagacaaatgggattacattatgctaaaaagtttcttcacagccaaggaaataattaacagagtgaagagacaacctatggaatggaagaaaatattgtaaaccatatatctgataaggagttaataccaaaaatgtatgtgaaactcctcaatagaaaaaaacccaaataacccaattaaaaaaataggcaaaatatctgaataaacatttctccaaagaagtcatgcacactggccaacatgtatatgaaaaactgttcaacttcactaaccattaaggaaatgtaaattaaaactgcaatgagctatatcaccttatacctgttacaatggctattatcaaaaggaccaaagataagtattggagaggatgtggaggaaagggaactcttgtacactcctggtgggaatggaaattagtacagccatatggaaaataatatagaggtttttcagaaaattttgaaaataccactacaatatgatcttgtaatctcacttctggatatatgtccaaatggtatgaaattagtatgtcaaagagattgcctgcattcccatgttcctcacagcattattcacaatagccaaaatatggaatcaaactaaatgtttgtcaacatatgaatggctaaagaaaatatggcatatacacacaataaaataccatttggtcttaaataagaaggaaatcctgtcatttgagatgacatggatccacctgagggacattagtaagtgaaataagacaggctttaccacatgatctaacttacatgtgaaatctaaaaaggttgaaatcatagaagcaaagagtggaacagtggttaacatgggctgtgggatggggtggagttggggaaataatggtcaaaggatacaacattgcagctggataagatgaacatgttcaagagatctattgtacaacccggtgagtggagttaatagaactgtattcctgaaaattgcttagaaagtattttgtgttcttaccacaaaaaaatgttaactatgtgaagtaatgcatgttaattatctggattcagcctttccacaatgtatacatattttaaaacatcatgtggtacatgataaataaacacaattttatttgtcatttaaaaaattacttaaggtttagaaagtagaaattagaatagttacctctttaaagatatttgcacaattaaaaagatttttcatgtttcttttttgaaaagtaacatatatacaatctagtactaaaccttaacagatagttattattttaagacgacagaaatgtgaacattttacttctgatgaagagaatctataagagagaaagatggtgatgctaaacaaatgagaaattataattattaaaatacaacaaggtatctgggatagaagcaagacaggtggaaagattcactcatgctttgccctgccaggagggaatattccagtataatgggcagaaaggaagaaaacatggaatgaatgcagtatgattaaaagtctggtgataggataaggatgcatctctagtctagtggcttcaattttctcagcaaagtaggaggacaattctgatagtaaggaaggaatggcaggattttaggtttgagagggtgaagcgggtgaaagcactgcagagacactgagggagataactaggaattacagaagaattgccaaagagcattgaagtctcaaaactcatcttaagttggataagtacacaattttaggagcagtgataggtaaatggcagaaagtatatacaagtattaagtaacttcaggctcaattccatccaccgaaatgttgggacttacagaaaagcagattcaatatggaagacgtggctcatatctgtcataggaataacagaagaagtagtagtaaacgtttattgagtacttactgaatcttctgtttaaatgttttacataaattttagtacacggccagtaaatagtgttattattttcagtgttctaatgagaaaaccacagcacaaagaagttgagtaattttcccaaggtcaaccagctacaaagtgcagagttttaaacagtgaatccaatgcatgtccagagaaaagtgagcaggacagcaaaggatctctgcaatataaggaagaattagataattgaggatattttgcctaaataagacaggcagcagcaaataacgattgcttcaatacttaagtagttgctatatggaaaaggaattagagttttacattatgtttcttcagggagcaaaactaaaactaatatgcagaagctgcaatgaagtagatttcatctggaaagaatgatttttgtagccatgagaaatacaggtgaagtagaaggagcagcttcagaaagtgaagttccagtgaccaaggagtttgagcccagaaagggatgttaggaaggactttatacataggtgagagaggacttgctagtttatgtaaagttcaacacccattctaacactgaaagtctgcctctagtgtgcattttattaaccccaataaacatttacttttttattttctccccagagtaagcatgttggcagatacatgaagcacttggatccatgtcatgacaatatttggatataacagataagacataatgctttgccaggactgctagacctgggctttcaattgcttccagggctataataaattcagatgttgggggaagagagaggaaaggagagagtgctttttgttgttgttttttgtttttgtttttgttttttgcaatgtagccccttcccaagagtaagaaaaaatattcttctgacaattgtaaagctgtttcctgccaaaattgtcattgttaaaacttttaaaagataatccatatgtccccacacttcatactcttgcactttcatgcaaagagctcaaataagaaaatttgaagtttttctctgagtagaggtcagtgtttctgatgcagtgccagttttaatgagaagattttattttctctctctcttaagagaatggcacgaggaagctacatgttaagaagttaagatggtctctacttggacctgatgctaaaagaaggttcatgccatattttatttgacattgtaatcttgatttggctgcccaatttattgaaaagattaatattctctacaggttttagatagcaaattttaagttttgatcctgacttgccttagagagcctttctttataaagcagctctcgttctttaatcttatagcaaccttactgtgttcttgctcctgttcttcaatgtggtattgtttgtttacctgtttgtgtagaatgttaggatgccacagttaaaaacaacacacatcccaattcattatgatccataggcatcacatgctgccactaatatgtacggtaaagcttacaccatccaatctgaagcaaatgacaaattcctgactctttatttcaggcacttctctccttgatttgtcttcttcaacagctgtcatctttgcaatttctcccaaatcagaccctatattactgagcaatgtacttgcacactttcatctttgtaaactactgcatgtctgctgctttataatttttattttattaattgagaatagatttccacccatttttcaataacatgcagcaatcttagtcactaaatattgtttaaaataaattctgcaattttcttacctgaaaatcagatagttttactttttgcttcaaattattacaaagctaccgtatgggaaggcagtcgtgcaattaaaccctggttattaagaattttgagagggaaatcgaacatggaaatatcacagctgaaatatttacacttaagtccttgtactttttttgctgattgttggaagcaaacccaatcagcaattttggcagtgagtagctatagtgtaaaacaaagatggagatgtggatacttatcatggagatgtgtgtccctttcaatttggtctgtctgatgaacagggagagaaacattgctactttattgttttggttgttattgttttcacaactttcacctaactctagtactctagtaacttgtctgggagacctgggcttgagtctgatttccatcacttgtcaatgactagaaaattctctctctctctttctctctctctctctctccccctccctctctctctctgcattcatttcttcatttgaaaatgaagagctagattggatactctctaaaatcctttccagctctaaaatcttgtttttatgagacactatttctggaatgagcaattaagaaataaataaataaaaatttaagtgatgtgataatcaagattatgtaactaaaaagatatgagagaataaattaccttttaaaattcctgaacaactcagtgggggaattattctgcctcagtgaaaatataagagaggaggtcaatgttctgtgttatcacataattttgacaaagccaatgagtgaggctaccgttaagtgccagcattggagagtttgcatgcaaacacaaaagaagtaaaaagcggaaaaaagaagaggtgtgacaaatggaaggtagcctgatcatctgcctgcagcctggccttctctctcttttctaaaatattttttggagacagggtctcactctgttgcccaggttggagtgcagtggcctgatctcagttgactgcaacctgtgcctcacgggttcaagcgatcctcacacctcagccacctgagtagctgggactacaggcacccacgaccacacctggctaagttttgtaattttagtagagacagggttttgtcatgttgaccaggctggtctcaaactcctcaagggatccccccgcttcagcttcccaaaatgttgggattacaggtgtgagccaccatacccagcagtttttttcttctcagtcatattcattcatttattcactcattcaacatgtattcactgaatgaatatttattaaatgcttatgatatacctgaaactcttctaagaactgggactatatcattgaacaagaaaattttccataccttatgaactttacgttttagttagggagacaaaaaataattaagaaaacacacacacacacacacacacacacacacacacacatacgtgtagttcaatttaacttcagatatacaatgctcaaataaaaaatgaagcactataataagatagaaactgactaggtatttagatggagagagaaggtctctctgaggaggtaactttgagtagagacctgtataagtgaggaagagaaccatacaaagatttttagaaggagctaaagttttatttagaaggagctcagttttgtaactgagatctttgcttctattatattttctaacaggttgttgtgagaaaagacttagaaagacctattgtgtacttacaaggaatatttaaatgccgaaagtggagctgctatggtctgaatgcttgtttttttacaaatattcatatgtttaaatcctaacctccaaggtgatggtattaggagatgggacctttgggaggtggatggttaatgagagcagagccctcatgaatgggattagtggctttaagaaagaggtcccaagggagcatgtttatctcttctgccatgtgaggacacagttagaaagtattatctatgaaccagaaagtgggccctcaccagacatcaaatctgcccgagctttgatcttagacttcccaacctccagaactgtaagaaataaacttccgctgtttataagctacccactttatggtattgttttatagcagcccaaatagactaagaccctaggagatttaatgaaaataaagtacttctaggatctaggagtcaaaatatcattatgacaatattgacaatattcctgggttttttttctttttcatagtgacagggtctcactaagttgctcaggatggtctcaaactcctggtcttaaaagatccttctgccttagtctcccaaattgccggtattacaagcatgagccactgtgcccagcctattcctcattctaagagagaatagggaattaacctatgcacatgggttccaagatcttacctgcccatttgctcatacaactggtgactgctcattgactaaaagaatggagaaaggggctttgctctatttctacttgtgtacctcaagatgccagtgtggttcttctgtgagatcactaaaatattagttgatagtcttttaactcactggtttttgatccatgaggcagataagatagcctaatttgtgatatgcctccaacctcttaacttgtgataactctaaggttaggtgggacatccatatttctttagggacaaccttcatactgctgtagttcttagagttgtgctagagagacaaagttatgggattgagccttgcaaaaatcagtgaccaacttgtcatctcataaatatgtggttggttacaaaaggtccctgataagaaagtatgaatgcatacaaaatttatcataaattccttcaacatagaaggtatgctttttgcccaggaattttaacttgttatttcttctccctagaatgatttctcctcagctgataatatgtatcacttctttaattcttttcaggtttttgctcaaactcagagaagtcttccttcacttccctatttaaaattgatctctactctcattatcccatatccccatttcctgctttattttctctccaaagcacttatcaccatctaatatatttattccttatttattgacttttgcctattgaaatgtgagctccatgggatcagggatttctgtatcttttattcaatattttcccaaggcctatggcaactaatattggttaagtgaattaatgagttcttagtgtgtttttgttagagtttggtatattaagtgctcagtacagtgcctcgtacatagtaaatactgaataaattatagctataattattattcataaaccaactgaaatatatattttttgatactaaacaattagatcagtcatgttagaccattcatatcactattttcattctgccaattttagaatctaatattatattagtccattttcatactgctgataaaaacatgtctgagactgggaagaaaaagaagtttaattggatttatagttccacatggctgggaggcctcagaatcatggcgggaggcaaaaggcacttcttaaatggtggtggcaagagacaaacccctgataaacccatcggttcttgtgagactgattcgctatcacgagaatagcatgggaaagaccgccccctatgattcaaatccctcccacaacacgtggggattctgggagatacaattcaagctgagattttggtgaggacacagccaacccatatcaaatgtcattttctttttaaacctcttaaaacatttatattagttaaaaataatttcataaggcagaagaagtaagtcttgaggtataaagcattgatctctactctcatatcccctcttggtctccagggttttaagtgcaccaaaacaaaacaaaacaaaaacaaaataaaaaaccaacaactatgtacaatgtacaccttggccactattgctggaaggctaacttttattagcctgaaggttgttgatgcaggctttatcaccgaagagattaatgtaaaattgctgagagtctgccaacagggtaaatgttcccagagagatggcaaaagcagcaaggtaagagatttaagtgcctcaacatttcttattaatttttagtgaaaatgttaaacagtcgaatcaacgtatggtggaattacaattcagctcacagttagtttgtaaaaatttcatgcagcttcaaaaagtctggttcaaaaactggtgcactgctcaccatccatacacattataaaattaaaaagttctggatgccgcaagtgacctctacatttgcagttgttaaatccaagaactttagaaactagaaaacatatgcttaaaaacgaattgttgtttatctaaaattcaaatctaacagagtcttctctattttatctggcaagtctaattcatggggaaaatacattctactaaaattctgctgctaaattaacttttcttaaaacaatggagacattggtatccttaacaacattaatcaattaattaagacatacattcttgcaatgacaaaacatatacaatttgcttactggtctctctgaattcataatcactaactttaagagggcgtttagcatacacctgcaatcctactacattttgctggaacttccctactgtcctagatgaccatctcctaacttttcttcacctcttaaatatgcaacaaccctaccattttcttttgtttttgcaggtacactttcttcccctttcattaacaaatagaagcaactggaagagctcttctacttactttctcaacatctattcactctctcagtctatgcccatggccttccttcctctgtcctttctgtctcagtcctaaggccaatccttcctcttaagcaccagatcccatctccttttgcctcttaggggtatttctactacaattgttgtctgcttccctccttcaagatcctcaactttatcttctctaatagattatttccatcagcattcaatcatgtagcaatattttcatctgagagagagagagagaaggaggggaggagggaaaaaacagggaaaggaaaggaaggagaaaaatgcctcctttggtctcatatctaccttcaagtataatttcatttatttgtttcctccttcacataaatcctgcttaaaatgtttacctacttactactttcaattcattctatggtctttcctcccttgaacccactccagtcaagattttgacccttcttcactgaaattgcttctgtctaatttaccactgacctccaggagctgaatccaatggcacattcttcgtcctcaccttaattgctgtatgagtttcctagagctattataataaagtaccagtcttatcttactataatctattctctacacaacagccagaatgatctgttaaaaggtcagatcatgttacttctccatctaaaacctctaatgattcccccttttttcagaataattaacaatgtccttacaatggcctaaaagctggcccctccccagtcatgaccatcaactcccaaaccaatgcaccgttccccttatgtccctttcacatacctcagaatttactcttcccactctttgggaccatcgtcctccaaatttgtccaggatattttcatgactttctcacttagtttcttacttctatgcaaaaatgtccacttaaaaaggtttttgccttttacaaaaaaaaaaaaaaaaatcctcaccagtaacccaattatgcctttcccactttgcttttcacctaggcttaagaccacctgacacattacaaatgaataaaagcaattattttgtatctctccagtttgctgcctttctctcccactctactggaaactaacttctaagaagactgagatttttatctcttgttttctattgctagtgttgaaagaatcactgaatcaatcagaacataactctaaaaagttaatcagagttcagttctgtacaccaagttaaagtcttgtaaccagtgaatacctagagcaaaattaagaaaagattgtcctttagaatgcagaaacttctgcatacttataaaatcttataaaattgttacactgtgaattaaacatagttttctcctttttaaattagcattagtctccaaagaattttttctagttggacaaagactgctattacttatattttctctcctttgtcaccttaaagagtaaaattttttgccagttattcttttgtttcccttaatataagattagaacctctgtagccatttcaacatacaaattcagcctatatctctcctgccaaatgtcttctgtactaattttatattttatattaattttttatcatatacaaaaggttaatcttttatacaaaagattaatctttattctgtgtcctgctgaatacttatcagaagtttaatctcccccagacacttttatataaatatttatagggttgacattgaataataaaatgaaagctcctgatactcttgccctgtcacatctcaaatagtttttttaaaaagtgtcaatcagatttatagcactaactaagtcacataattgagcacagcttgaagaccctaaatttaccaaccataaaaggaataattttaggaaacgtttggagctctgtatgtaagttactggcagagaccttcatgaatattggtcccatctccatgcagagaagagaagatcttggcctctgatctagttgtggggttggatgaagctagcctagtagttgtgagccttgtcaggccctttgggaaatgacagatacaggctcattatctttggtgccatgactacgacaagcctgaaatctagaaacatgactattaactgactggaatcatctaggtatgttccgtctctcctactcttcctggtagggagcagaacatagcattcagcccagaagctgatgttgctaggaagaaaaatcccatgggaaaaaaatctctctcactgatatttctcactgggaaatgctcattgaaataatgcctttcaggatcctttgataatattattcaattttgtccttacgacaatattataaagctttgctcatccaccctggctgaatatgagtcagctgaaaaaattaaaaaaaaaaaaaaaaaaaaacagagatccagaccttcctacaaactggataggacccagacatctctgttttgtaaagactctcccagtgatttaatacaaatacacagagcggataaaaaattatgtaaaaaagattggctgggccaatgtagttactctgtataacaagtaagaaaacaggtcagacaggttaagtgacttacccaaggtcacactgccaacacaaggtcttctcttgccatcatatcatggtgccctctcccagcttccccaatttctactatttcatataaattttctgccttttcagttaatgaagcttacttcagctcatttcagctcagaggagaaaaacatgaacaaaattggactaaaatgggtgtaagaattggttcatggaggataaaaagcattggatttctgccagacccttcaggatgtgaatcagtcaaagaaatcaagtcaacacataataataacaacaaaagcaacaactcttttggtattttacatagtaaagccctttgcatgctgtaatttcaataatgattcctgcaaatgcaaaagtcacacaattttatctctgtctttgtattcttttttatttcagacattctttgtataggcttagatttaaacaacataaatatctgagaatctttacccaatcatgagtctgaaaaagtcaattgatggattcttataaacattgtctaacttccccgacccatctgtttcaatgccagcataggccagtaaggccacatttgtccattgaggatttaaaggcctgatgttctaaaagtctgaaagatcctcagctgtggagagatgacagtgtcagaaattcctgactagcaatacttttatatgatcataacttctttttaatcataaaacacctcttttgttttataaattttttcccttcacctttctaaactattctcagagattacactttccaaaaaatgatatttttgtcacatattacaactcaagggccaaaacagctggtttatgacttataagtactttgtgaattgcttgagctggtggggaaggttagacaataggaacgaagttttcctactataaatcattgagtcacagaatcttagctttctagaactagaaaagataaacacaatctaatataagtccaacacattgcaggcgagaaaacaggcccctggatgttggtaaccagttggggccaaacagggaattctggacagagcagacagtagaagccaagttcgtttgccttgactcccatgtattttcctaagccagactgtctactttggagtatgagatcctctgagcacatctaactctgtcttctccttcaagattcaattcatttgctgcctggtattacggaatttcaggaatgaaagagatgctaaaatcatcctgtccattcagggtttgacttttttctaccatggtccccaccacagggtcaagtactttagtaacaaaactcctaatgaagcagcctgttccatctttggatactttggattaaataacttataatatttagctaaaatgttttcctaaagcaactgttaaaaaattgatcacttttgtcatataagagtctcttatatacttgaacataggtataataaggacaccttttttgcattttccccagaataaccattgcttgcctttaaaatttcttcatgttgtgccatcctaattgctctcctttatatgccattaggttttgaaatatgtcttaaaatgtggtattcagaattaaacacattattgtaaggactgctaagaacagaatttttctttcttctttctagaatattctctattaaataaagcccataaatgctcaacaggagtgatatcacccccaagaggctgaaaactggttcttggggaaaaaaaacttacttttttaatgtataaagcacatataatgtacataaagtacattaacagatatgttatgtacttaaatatctgtggtattcaaatttcattggggaagtgatcagaaaaaaacatttttagggactccttaaagggataatagttttttttaaaaaaaggctgtgaaacagtgatatagcctaagatcacactagcacattagctattttatcagagaatcatactattaacccctattgagtttatagtcaagcacaatccttaaaactatctatctaacctacttgtacaactgttgaaaggtattttcactaccgcgaggtttccagtgtgtttggttggttagatgattggtttgtttttgaagagtagtaattttttttttgcctaattttgttactataagagcacaaagttaaatttatttctgataaaattgcccttgttaggttttatctattcccgcctgtccagatattttggaatgtaatacattcattattttctgaagctctgattatttgcaaattttatctcctatcatcttgattgctcatgccagtaatttgcagaaacaacgttaagagaacagagctgagaatattgtcccgcacacaacttttccattttgtgttaaagtatcagcagtatgttttgactaacatttcttcatcgaggtattaatgttactaactgtacatttccttacataaaatccatagttttctatttttttttatttgtacactctgagaaagaatgtcaagtgtctcacagaaatccagattgcctggctctagtatactttctaacagcctagtaagccaagtgaataaagaagcaagatttagtcttttgtttttctttaataattctgtgctggctcactctcattacttcttcaatttatctatacttaagaggttctttttagtagtctgtacagacatctcttcccagcacagcttaaatattctattgactgcatttctccctataacagtatttgtcagttacatctagttggctcttgctctgtttgttttcatgggcatatgccttaacttttcaaaaaagattataaactcccagggttgaagcatatactcttatagtgcccacagctgcccattaaagtatcacagaagatgataaaaataaattgtttgatttactaataacaaactactcactatcaaatcagattgatgaaaggatcatgaatcattcactcacaccctagcccaggtttacagattgttttaaatgcttgcttctaataagggtgtattaaaagagttaaatgctttcttctaataagggtatattaaaagagtttctttccaacactcaatttactaatttatcactaagaaatagcgtttttgctaagtaataaggaaattaagaactgatgatggaaaaggaaactatataggggaatataatgggaaacataaaagggaaatatgtctgcaaaaagtaggattacaaggtcatgtttctttagaatgaggagcctgtttccattttcacaaattaaaatcatttgaaagcacatatacttatcaggatgggttcctaaaacttttttctcaactctcatatgtgtgtgtgtgtgtgtgtgtgtgtgtgtgtgtgtgatacacatccacatatatacatacatacacatatatattcaaagatatataatcttatatataaaatatattggccgggtgcggtggttcatgtctataatcccagcactttgggaggccgaggtgggcggatcacttgaggccagaagtttgagaccagcctggccaacatggcaaaacccgtctctactaataacacaaaaattaaccgggtgtggtggtgcacgtctgtaatcccagctatttgggaggctgaggcatgagaatcacttaaacctgggcggtggaggttgcagtgagctgagatggcaccactgcactccagcctgggcgacagagtcagaccctgtctcaaaaataaataaataataaaatatctcacatatatattctatatatatatatctcattgtgcaaagttcccaaattagacattttgactacattaaaaacacaatgactacttggataaaaactggattaccaaattatctaaatgagccatttgtgtgctatttgatggtggtatatttttatatcttggatattatccatatactgaatatatatgttccaatattctaaatctctaatataattcaattacttgaaataacatattaaataatctgagagagggcggagaacgaattaagcctcaattatttttacaatatgctgtatgcttggtgttaacacaggtgttcattcattattctcaaggcctttttgtatagctaaaatatttcatattataataagttgtgtgtcatagcagatcatgttaaaagaaatctaaagttgcccgagcgtggtggctcacgtttgtaatcccagaactttgggaggccgaggctgatggatcacttgaggtcaggagttcgagaccatcctggccaacatggtgaaaccccatctctactaaaaatacaaaattagccaggcatggtggcatgtgcctgtagtcccagctactctggaggctgaggcacgagaatcacttgaaccgggaggcagaggttgcagtgagccgagatcacaccactgtactccagcctgggtgacagagcgagacttttgtcaaaaaaaaagaaaaaaagaaaaagaaatctaaagttaaaaaataatctaaagtttccattttgccattcaactgccatgtttacccacagctcctcttttctggtagctgttttcagttaaggaaagggaacactgggtggaggatgggacaggaacactcctttcacagagggctctgcatatagcagtccccttgagcatgaattttccaagctttgataaaatctattgaggaggtaaagagaggattcatctttaaaatattgtcaatgtatagttaattaaatagagtttattctgctgcaatcttacagccctgagaggtacagaatgctgaggttcataaatgctgtcagcaacacagtgaggcagtgagggtgaggagaggaaggggggataaaaacaattgcatgaaaaatagaataaattttgagatgtcttctaaatcaaagctcatccaatatggagaattgaaaaaaaattaaacaaggaacatttgagattcatggtatagaaatctccctttccctaaacattctttaaggtcttctttcaattatttctgacagttatggcaacatattatgagagtaatatgtccactatgggggggatacgcattagttcactattgttgccataacaaattaccacaaacccaacagcctaccacaacataaatgtatttgttctcagttctataggtcagaaatctggctgggttcagctgattcctggggtctaaaaggtccaaatcaagttgctggccagcctgggctcttatttgaaggtctgagcaaagaaagtacttccacgccaaggtcagtggctgaattcaattccatgctaccatagaactgacatctcaatttccttggggctcttctccagggatggttcttaacttccagagatcaatcactttccttggctcagcgtccccttcctccatcttaaaggcagcaacaataggctgtgtccttctcacattttaaatccttctaacctccccttctacctcttctcttctaggctcccctcaccgactgatttttctgttctccgattctgcccttaaagggttcatgtgattacattgatctcacctggataatctaggctaatctcctttttctttaaacgtcaatgattagtaatattagtttcatattcaaaattccttcaaaacattacctaggttagcatttgattataaccaggaatgggaatcttgcagagacatctgaattctgtctaccacagggtgtgcccaccagattcaaacagacctgccaaccagaaattggcagtttgatttatatttctcagtctatgaaacataacatttctctaaatgaagcattcttaaatagtatttgattactcaagtggataacttcatggctaatgataaagcttttctattagaagtttccattaagaatgcttttgtttgagttgttttgtgttttaaaacaggacttggatttcttgggagaagctgtttaaacaaaggagagaggatattatttgattacaattagagatgtctttttgtaggaagcaattatcagtataaattaagaaccaaactgcaaattcaattattcctaagtatttactagagaaacattagtttaactgtaattcttctggaaattaaccccataaaatatgttataagagcattaattgcatttttatagttaaaatatgacgcaataacaatattacaaaagctatttgatccatattaattttgtacaattgctgaaaaccatctattgaaatcatttttttaatatttgaattggagtgcattaggttactcctttgaagatttatgcattacccaagaaagagaaaaccaatttttaaaaataccaattaaatgaagatactcagttaaattaaaaaataattctaatgctccaaattcttgctgtgaatttgcttattgtggaatcagaacatatttgaaagaatgaaaatggccgattttaaagtacttttgaattttctgttacttttcttgttaaaccctaaatagttataataattgtaatgaaaatgtttttagttactgacctccacatgagtggcaacatgagtttcacacagttacatatattcagctgataaaccaggtagtaaaaggaaatgattaagatcacaggactctgaagtcagactacctagatttcagtcccatttgtcactttatctgaatggcttgaggcaaattattcagcctctctatgcctcagcttccttctgtaaaacggggataagagtagtacacattactcccagggttgctgtgaggataaaataggataatacatacaagtaaatacatgtaaagtcatgtaaatgtttcatagttggtatggactaaataaatgctggttattattcttgaagtgatgtccaatgttaggccctagactgacaaactgagacctcaactcttcaaacctgtcagcattaggatatagaggcaaacagccttggcctcagtagaactgacctgtagtcaagtcagctgatcaacagagagaatggaggaaggggctgaagagtccctacagaactccagcaattagctctgtactcctactggctagctatgttttcaccgctacaaagatgctatcgatatatccctcatcctggccattcaccttggtcattcattttttatcaaaaaaaaaatagtgagtacctaacaaagttataggctctgtgtgaagaagatataaagagctgaattttaaaattataagattttctgctcttacggagttcacagtcttgcaaacaaacactagcaaccccaagccatccttccttttgactcactgatttaaattgaacaagaaagccactttcctattgaaagtaataaaaattagggaaaaaagatgaaaatggtatcatgagatgtcgaagttgaggtgctatcaatgctttgggggttatgtatcaaaatttccttaagacttttttacgacattgtcactcacagttttattaaaacagacactcaaaggaaagctatggaaaaataacacagtgtctctggttcctacaaggtatttggttatggtgggagaggagacgtaaattacctctttacttccacatacccacagagaccctccatcacatctgcttttctccacccacccgagcaacacccactatcttaataccaagtgctgtataatcaactgagttaaactattttcaatttaagctcaagaaagtttagaagagctccttaaggagtagcagtttagatccaaaaagctcttaagattgatcagccttctttcatgcagtctatattctgagggtctcagaattttaggcttagaagaaaattttaatatataataaaattattttattcttctaaatatttgaataattttctcaaagccatatggatgttagttgcaaatccagatctgggccttaaattccatttctatttcaacttctttccacatcagcatgtattataattgaatataatgggcatttactactgccaaggatagattctaaagtactgattcaatctattgctaatgaggcattaaatgtccacagctgataacaaatagcatgaaaaatatttgaaaacagaatttatcaccatttagcaccactttagtcagattgcataccacctttgtttatgtattccatcatgcttatctctttgttaaagatttttgttcgttaaatcaccatatagacatattacatacattaatgaaattataaacttgactttgaagttgatgtagctaaaaaatattgggaaaagagtaaaagattcattaagtgttgctaaattgtaagtggttctatgttatgtttccaaacaaaagaaatcgtctacattacaacattgtaaaagtaatgaccacaaataaaataacactttaatacaccaggcttgctccaatactgaaatttttcttttagtttaagatacaaaactcctagacacttgtttattaagaatatctttactggtggaaaatgatatatttaagcttccaatttatgaataattaaattcctatgattagatataccaaatacagccacatcgtcaaaggatatactacataatcttaaaggcaatgaagattagatatgggccttattatattcatcatttcaaagaaacatcaaaagacatctgaataaaataaacaggagtttttatttttatttttatttttgcttgtatcaagaactttctgagcacactgtctggcaaatttagagtgtcagattagaagttcaatggcaatttgattcttgtctttgtaaacatttttacattctaccaggaagtgtataggtttttctttttattattgaaatttagaaatctcacaataatatctagatgtgagccttctttcattatcactatactaactcagcacttgttaattttttttttggtctgaagcctcaagtctttagctcaagagagtatcttctcctgtgactattgtttctcctcaatcaattccatctattcttataagatttatgtattgggtgttagtgccaagattctctaatatttgctgagattttctaacttcttcttttaaaatctgacatatgggataactccttgggtttgcttctgatttttattgatagctgttgtgctcttttcttgtcctagtaagggtttttatttgcttttgggtttttttgttgttgttcttttattatttcttcaaaacaatggtcatcttcttttcagtttctaagtccttggtattcagtgtatagtgtaattaaggttatgggcactgaatgtaggtctttctagagccttgggttagcactttcctagctattttaccttgggcaaggtatattaactatgcctcagttttctcaccacatagagataatgtgcaataatcttcagtaatattaccctattgctcctttgcatagcagtgtgtttgctcttttacagagtgaagaaaaaaaaaacctcccaaatatcaatgaggacatcaattagaattctaaatcattatcttttgtctacctgtaatatctatatttcatttgttctaattcccagctttatccctattctctccaatgatgggtaatactttattatctgttcatatgtatgcgttcagcgttagattgcccatcctagtggttgatacgggctccctctgcttaggccacctttgatgtcatgaaattgctgtgttcagggcataaagaggaacagaaaggttgatttattcccaggtgcatatgctggaaatgaacctgatacatctgtttcaaagagaaaaagcaaagttaaagtgggtaggaaaagctccaactgcatttagaatgccgatgacaccaagtggaagaagcaccagggcaaatatttcagctatcttctctctgcagagctctaataaatcctagagggcctcttgtgtgattctctctgacattcccactctttcaaatgggggttaaacaacgctacagcttcccaagcataagattcccacagttttctgctggaaagactgtctacttgcctctcagggcttccttacctggtttatattgagcaaaacaaaagccattgtcagctccttgattaaacccgatccatctgctgctgcttttttttttctttttaaataaattactgaaagagtatgcttgcttgatgttacccttcctattttctagtattactacatacctttttgctcattttgtgcttctttagtcattttcatggggttaagatatgaagggaagaaaaaaaatgagttggtttaacttcccatcctaaagctggaaattatattttggatcttgaaaataaccaaaatattcattatttttatggcagttgagttagtcgaggaacagattctatgtaatgtcatgttaagttgcttatttagctaaaatgatgcaaagtaaatagctgtcaacatgattaaaattacttgcaatctgaatttaattaaattgagaactatgttattttcctactttctccaacctctggccacttaattagtaagatttacttttagttcatctcaaaatttctgtgcttatggtcaagagtggttatgtgaacaactcaaaagagacatccagcctgaatcatttttattggcacagataccattatgtgactgtttgggttactatttgccttcttaattatattatcttcagcctaatacatgaaaataagatttcaatccctgtggctatgacagaatatttgggagatactatctggagaaagcaaaggctatgccacccagaaatttgaatctggaaacacagaagttgcaacctgactatataaaatcaaaaggaccaaagagaggtgcaaggtctcagagctattgtttacataaaaccagtcatgtctaaatcattggaagaaagcttttgtacaacggaggatttattttctgttaacataaataatgggaatttctacatgttagagttaaaacctttaaaacacacacacacacacacacaactgcaatttatcttattccttccaggttgtgaaatggactgggggaaaaagaaaacggtgacagagaaagaggttagactggcttgttctgtgtaggcaggctgtcaaaatggctgctgggataggaaaaggtattcaactttatgcagtgaaggaagctgtacagactcctcctgagcgtctgtgaggtcaaatgctatgcaccccaatctacttcctgaaattaatagccaggtgttatgctagttactgtaccttaatcattaattatgactgtggcagcaagagagaaaaaaattctaggatacatgagctagagtgataaagggaaagcatcaatcacgcatgacaggaaagccaaaggtaccctctctctgcctgggatactttcatttgtgactgcagattttctcctacatcagacttcaaacttcagagaaaccatttctcatagcctgcctctctctctttctccctctcacaaccagctatggtcctaggactcaggaggatgaaaacaaaataaaacacatttgttagtaatgccatattttccatgtactaccaccaggatctatttgaaattaaaggtaatttatacaaataaaatattcagtcaagagatgatttattcaaaaaagcaagctacagcaagaatggagtttagagtcaatagttaataaacattctggcagcacaggctggcccacatgccttcatttttctacaatgtcataaatgtgttgcatgtcatcttaaacaagtgggcagagcaggtgaatctccctcaaagtctcatggcacagtctagtatgttacaaatcttgataagcagaaacccaagccacattctggtggtactgagtggtcagaaatggggtatttggaagtaggaagaaatacattaatttagttgaatggaaggaaactaagttgggttctactttactatggtattgtggatagattacttgacttctctagcattggtttcctgtttgtaaatgactggtttgagccagatcaggaacccttattctggggtgacataggagcttcagaggatctggcaggaaactcaaattataggagaaattgttcagcatattatttaagtgttactaaaaaaacatacacactaaaggagtgcttctctaactatctgtagtgaagaattagcactttgtaatttccaatctgctatgaaccacctccttttaaaaatcatacaaaaatgaaataaaaaataattttatacaaaatagaagcccactttttttttaatcagactcaatagatataaaaatactccttcaagttgctataaagatgatatggtatggctgtgttcccacccaaatctcatcttgaattgtagcacccataattcccacatgtcatgggaaggacccaatgggaggtaattgaatcatgtgggcggagctttcccatgctgttttcatgatagtgaataagtctcatgagatttgatggttttataaaggggagttcccctacacaagctctcttacctgctgccatgtaagatgtgcttttgcttctcatttcccttctgccatgattataagcctccccagccatgtggaacctctttcctttataaggtccattaaacttctttcctttataaattacccggtctctggtatgtctttattagcagtgtgagaatagactaatacaaaagattttaaaatcttcctatcaacttgggtcattgtaatggactgaccagaactggaccataggtcaaactttgagtaacaactattctaaggttccttccagctataatcttaaaactttctatgtaaaaaacagatatccctatgtccattctgcctcaactcctcctgccaaaaccatacaatctcacttgccattgcattcagcactataaacggaactcaatctaaaggtccatcttccttgaaatgcaatgaaagattgtaaataataatgacaatgacaacaaaatatgctttcccttgtcactggtgattatttatgttccctgaacaacaaggataaaaatgagggaaagcctgtaggactacttaccactagaacctaggccatctgctccctgacctagtagttccctcatctatgcttttgtgctctcataattatcctgactcagaaagcctttactagcctttcccctattccctacctgcagtcttttcaagatccttactgcatttattgggtactcaaagcttatctattaagcacttacaaatagaagaggataaaattataattatttggtccctgtcacatacacacacacatgcacacatgcatacacatatatacatatatggcccctgcccttaagttgtctagagcaattcaatgtttataagtatgttatatgaagaatcacaacagggaatgcagaaggggcaatgacaaaagtcaaagttagacaggaagggtcacataagacttcttagaagaacacttttggggctatttcttgagtcatgactatctggtgatctggctgtaatattaaagaggcttagtcagctcactgaactattacttgcagttcttcccttcctttattgctacatatttggtctagaagtacattctttccaaagagtcgactcctctttcatcaagagtgttctaattaactaaggggggaaaaacatgtgtatgagagtgtgtgtgtgtgtgcacgcaagtgtgtcagttttatgtgtttggtgggagaaaggcaaagaatctgggagagcagcgcatgtaaagtaatgtttaaaggctggagaaggagggaccaccaggtcatgaagcttcttgtatatttccctaaggattctggattcatcctgagcacactggtgactcattaaaaggttttaagtaagggtgtaatatggtcaatgttttgtttttaaaagatcactctagcagcatgatgtaggatatctaggtggtgagcagggtggatctggtagtgccaaggtgttcatctaataattcaaatgagaaatcatgaaatcctagactaagtcagtagcagacaggaatgcgaagccatttcaatctgagacagatttgaagcacaccaagaaggcagaattactggctatgaatcatggacaaatgaatgaatgaatgatgaatgattttgaggatactagcttcagcaattgggagattggtgatttcattccctgaaagagaaaaacactcgtgtaaatacaagatgagagtgtaacaaacaagaattcagatttaaataagttaaattcaaggtgtctgcagaatgtttatatggagaagtctgttgggaggtagaaacaggagtctgtagttagaagttgggtctggactagagaaaataagttgatcaacagtaactgaaggcttgagatgggtgtgattacttcagcatgccttgcctgaggaacttcattccactccaatagatttgattttaccccagaagtattcttcatttttatcacctgtatgttttccttaataggcattgtataaaaatatactcttttttactaaataaaaacataagtgggaaaaataagctaaagggccaatgaggtacagcaatgaagataaagttggactgtgacttacacacaacatgcaaactacttgataccatttactgatctctggatcacactctgacactacactttcaagcaacaatgcaaagggtgacgaaatcgcaagttacatatttaatactcatacaataaaagtaaaccaatttctccaaaacagaattatttatgttactgtgagctgagaaaaatttctcctgaaggtcctcataagaagagcattcaccatattaatggtgagcagtatcttttttttgacacggattctctgtcaccaggctggagtgcagtagcttgatctcggctcactgcaacctccacctcccgggttcaagcgattgtcctgccttagcctagcctcctgagtagctgggactacaagcacatgccaccatgcccgactaatgtttttttttgtttgttttttgtttttttgtttgtttgtttgttttactagagatggggtttcactgtgttagccaggatggtctcaatctcctgacctcgtgatcctcctgcctcagcctcccaaggtgctgggattacagacatcagccaccacacctggccagtgagccttattcttaatcacatccccatagtgaataaaaaataatacttacacaattattatatccatcaatgtaaggtgatagtataataacaaagaagagtagaggaaaggcaattcaaaggaagaagaatggcaaaattctgtcatttatgtggacagcccatgtggattggtatgtatgaatgaacagcaacatttccttcaggtattcatctataatacttgggatatgggatgtattttatctcccaaactagactggtatgtccacatctgcctttccactatttaatgtccacaactttcttcaagatgcattcatttgttccttcaatagtcaataattttctgaactaaagtcatgaaggactgagtcttaaaggatacttaggaatgattcagacaagatgggagacagggtaggaatagaaacacttccaaacagatggatacgtagcatgaacaaagctaccaaggtaagaatgagcttggtatgcaaagaaatataagcaatttagcatggcaacaatgataataataaggcagagagaatgatgagagaggaagctaaaaaggtagacaggagagcattgaaggaattttttcttatctctactcttggcaaatacaactcttggggactgagatcatatgtagccttaaatgttgcataagctgtgtatatggcacagaggtgatctccagtgtctacataaactttgtggaatttcactgatgaaacagtttgtgccatggctggagaaaagcatttggatgcatatttattgactgatgtatcggatgtgatgtgatgtttgaaatatgtcataagagtgctttctagaagaattacccatttgttcattatgtaagagagaaattgtttctggtcctctagaataggactttggggagtgactgcatattaccctgactcattctgccatcaatgtgctggagtcaccattcaacaactgcttcaactcacttggtcctaagtttggcagctcaaaattccaacaacctcacagaatatacctggggatccaaactggaaacagctcattagattcaaaataggagggtatattttagaaaataaaatctagcatacctttactggctcttaaaaaatcagattggaataggtggtctgaaaatgaatttatccagcaaaccatattaaaaaacaaaacaaaacaatatcggagtcctggcctaaataaagtggttggttactacctccctcttcaatcaccttaggctcttgtagcaaaaggacttttaccatattagctgctacaagatttaataaggatatgatgtactatatccttcattttgctaggcaacgcaacattctaaataagattgaatgtttgtcaatatttggaagaggaacctcaggggtttctttaaaaatttcctcttttcctattcctctaagactgattttaacctaaaactgattttttcttttcatgtatacaagatacctttttgggggtttgtgtttatttcccctgaagaaggctttacagagcttggattttaatggaaatttattgctggatgtttgatagccaaaaggattgtgttttgatcacagtcaaaatggcaattttctccacagtagcatagcagcatactagtacaaggccactgcagctagaaacctgtgggcgtgtcaggtcctttgtagtgagtgtcagtagcacctgcaagagcccaatccctaactgtgctggaaggaggtttgatcctattaagtttcaaataatatgtcagcttttcagctttgatacaaattcctccagaattatctattttcccacttgtgatataagacttcgtgaaatgtgtaaaatctaagagggtctgcctcattttctgtgttgggagagctttggaatgacctcggactctgtcaagactagtatttcttgagctttccccaaaccaattaatcttttcatctgggggttatacaatgcacaataataagaattaaaggtaaaaattaaaagaaaataaagaaatcttgttgtataagaattaatgcaacacaaacatagaggccatctcctcaaaactgacctggatggctacagattaaaatatggatggaaggaccactgagaaaaaagacagacatagagagcaagaattaatctaatactacatgtttggtacacaaacaacaaatcaaattgagcaaattattttctcaggagattctctcaatcactgtattttattatctgtgaattccagtaaaatcctcattttctaggtggaggctttcttttttttttttatttctgttttctttcttttttctttttcaggttttattttagattcagggggtacatgtacaggtttgttatatgggtatatttcatggtgaagccctttcaataacaaaaggaagaggtaaataattatacaaacaaaacaaagaaaagcaacattaaagaatacatttaaatgtgagtcaaaagacctaaattgagggccaacaagcatttgctctgtcacttcacttttctgtgcctcagttttcttttctggaaaatggaggtcatgaaaatactcatacctgccctcctcatttcacaggttgtggagcaaatgcaatgagtgtggctcaatcattgccagatcttaacgttgtacataaatgttagtgactgaggacaattatttaacccctatgagctttcatatatccacccgtcaaataaagcttggatactggcctgcctatccccaaaatgatcttataaaaatcaagtaaggtgataccagtgtgtgctttgaagtagtaggtgctatcaagtattagactgtcaaatatattcaaacaactgtgtgtgggaaaagattgtggtggactagaaatagccaaactttagaagtattctatagtctttgggaataaagctgggatgtatgaaaaaccttcttatgatattaaaatgttcacctttgaggaagaaagtagactagcagaaagtttcactatcaaaattctagaacattaactactgatactattacaagttgttaggaaacagtaaattaaactttgtaatgctctcccaaaggaagtagaaatacaccatcattacttatagtttaaattggactgggaacagtgggccagcatgtattatggagaagcaatgcttcagtagtagcaaagtgaaccaaatgacactgcagatcttatccatatttaatgtttgacaggcaaaaatacttacattaatgcagtaatgtgctatgcaagtcatcaacatgggaatgctcaaagctttaatactgtttaataagcatcacactatgagagcatattttccctttcaagtacgactcattcaagtttgagggaactgctaaattgtcacacttggcaaaatcttgaatgacagccaatctaaacaaaagcaatcattttgtattttgggctggtttgaagaaagatgggaagtgtgaggtaggcagggggatgtaggataccccaaaaggccacaataatcagacaaaacccccagcaaaattgcaaaggtaggatagacaagaaaaggcatcaatgctttgcgattgaacctacacaatgacctgatgtatacaaaaaagatgggattttggtcaatggtaaagtttatttcaggggctggaggtgtgagacatggctcctaaaagtaggtgtgtcaatgactaattatctaatttacaataagttgacctctctgtaattctgtcccactttttcaatttctaaaccagcagttctcagttggggaggggaaggaggataaattttgtcagggatattggggttatctggcttgtcaccacaggggaagtgtggtgctactggcatctagaaagtggagtccaaggatactgctacatatcctataatgcacagggtagccctccacaatagagaattatctagctgagattcaataataccaagcttgagaatacacgtgctaaactaaaatcatctgagaagtatattatggggtaaaatgggacctaatcattcttagcataaaagcaattttctaaaaatcagtattttattaatattactgttattgcttaagcttcttttctactgagtttccttttaattataaagcacttggcagaaaaataagattcatttctataataggcttagtgctttctttttcagcagtctttttcttcaattaattaacatttaactgctttcttataatgaaggccaaaaaaacaagctgtctccttaaacttctcaggagaagtgataaaactctgtgagtatattaaatttttctgataaagtatttgtaggacatagatttaggaggtctttctctcttaggaatgttacttataaacatttcttggaagtccaagataaaattaaaaacacgtgcatgattctagaggctacatatgctattgatgctgaaaatagaatgttggcaccggagaagtccttactatatatgtggatgaagatgaactcctatttattagtaattatgtaggaataaacgtgatgattctaaaaaaattatcttattgtctttgttggcatttattttaaaaataagtgaaaaaaaactataaccaatatgcaattcatagatcttctatcatggctaatagttcaaattttgcaagctattggtttgaattattgcatttgctacatataaaaatggaaggtttctaaaagaaaatgaataatagaaaatattcagatgaaaaccaaagcaagctataaggcattcttagaagaactatatatatatacacgtatatatatatatacacatatatatatacgtgtatatatatatacgtatatatatgtgtatatatatacgtatatatgtgtgtatatatacgtatatatgtgtgtatatatacgtatatataagtatatatatgtgtgtatatatatgtgtgtgtgtatgtgtgtatatatatatatatatatatatatatttttttttttttttttttttttttttttttttttttttgagatggagtctcgctctttcgcccaggctggagtgcagtggcgctatctcggttcactgtaagctccacctcccgggttctcgccattctcctgcctcagcctcccaagtagctgggactacaggcacccgccaccacgcccggctaactttttgtatttttagtagagacagggtttcaccatgttagccaggatggtctcgatctcctgacctcgtgatccgcccacctcggcctcccaaagtgctgggattacaggcatgagacaccgcaccaggccaagaaccatattttttttaaaaagtttgccactgtaaacaagatatttaaaatgaccatgaacaatttttatgtatctgtaggcttctctctttaccagaattaaagtgtggggtcctggaagaagcagagggctagaagccacgacacttaggtttgtctcctcatcttggcactttctgagatgttaaattattcaacttcactgattcttcattttcttgataataaatagaggggattagatatagagatgcacaaaatccctcccaactctaaattttcatagttttataagactttgagtttaaaatcatttgatctacttatataacactcataatttttgtatctttatttccatatgcacagtttatgttatgacaagaaccaactcaaactagcttacgccaatacaggaattgattggcttgtcttccacacaaattcagtcagcatgcggatcctgctccagggactcaaatggcatcctcagtatttgttttttctatatatctcagctctgcctcatgctatgtttatttaattcttgaggtatatgtagtaattccctattgctccaagaatactcttcagcagcctgggcaacatggcgaaaccccatctctacaaaaaatatgaaaactagctgagcataatgacacacctgtcagcccagctccttgggaggctgaggtaggaggatcaattgagtcttgcaggttgaggctgcagtgagctgtgattgcactactgcacctctgcctgggtgacagagtgagaccctgtctcaaaaaatatatattttttcccattttcaaatttcagcaataaataaataagaagctgtttttcttttcttctctctactgtcctagcaaaagtctgcttctttctagtttgctttgatcaggctataggcctctctttgaaccagtgattgcagacatagaaataggatacacagatttaagtggcatgaatgacatgtcttctcctgggaccagagatgaggtaaatggaaagaatgttcttgaagcaacaggaaaatacaataaatattttgagtattaaaccaatatagtaaaaagcagagctgagagagagaaaccaaataaggacaataccatttgaatccctgaaaaaatacctgtatgaagactgaaatttcatgaagaacaaaccaataaatctctgtgatttgctttagtttgagttgttgttgttttttgtttttttgtcacaacataattagtaccaactgaattaaagataattttttaaattacagagtattatatcctatattaaaatcaataaaaaattttaagctcaaagaacttgatgatatctttgatacaaatgacatactttatacttaataggttcccaataaatatgtattgtttggtacaatgtaatgaatatagaattaaaagaaatatgtatgtaccaaatgagtatgtaccaactaagaagaagggaaaaagggtacattcatttcctatctatataataatatggcaaaaagaatggaaaaatatatacataaatgatgcaagaaggaggcaaaaaaggtgataaatttcaaagtggaaacactcaagatatatatgttgtccttcaccaagaaaattacaaaagaccttgatattgaaggcttcttctttgtcttcttgatgcctcccatttcttctcagcgaatttcattggtacatacccatcctaatatgataagagcattttaagaaatacctgtaaataatattttcccctattctgttagaatataagctccataactttagaaatctttgttttgtttactaatatataccttatactactaagtaaatccctagaataaataaacaagacatagtaaaataattgtaggatgaattacaaacaggtgataaaatgaagaagcctgaggagagggccaagcaggatatgaactgttctgaattctttcttctacctttttttctcaccttaaaaactctggtccttatcacctgtattgattcatatatatatatatatatacacacacacacacatacacacacacacacacataccacttaagtcagatttcaggattcagaacatatggaagatggtgattatcttctagactctatattctaatgaaagataatattttcttttgggaggcatttcatatattccataatttattgaggaaaaaaatgatattgaggtcaattatactatagagtttgtaggataacttacttaattgtgttgaagattttagatttgctgagcttggaagaagaaaggaagagagattgtgtcaaacaccaaatgagaagctgttttgagggtaaaagatcctagaaataaaaaatatatggtagaattaaagtaaaaatatataaaatctaaaagaagattcctacccttgcattttgacttcttccctggtagacaaggctagaaggaaacaggatttacatggcaggagagtataaaagatgactcaagtatttccgtgaagaaaataaaaagatcatgtccactgtgtcataaaatcacatcacccttctgatcaaaagcaatcaagaacttcccttaggttttagaataaaatccaaatgtttcccctgcctatgtcctttattattacccatttgccctcatgattttctagtcacaccagccttcttgcagacctcaaagtcgccatgcttgttttcatcccaccggatttttgcatgggttgttcctctttcctggaatgttctgccaccctcagcccccaacattcccgtaactagtccttctcctcagttaggtcaaagaacgaatgatgtcacttcctcagagtgacatcttctctgacactatctacagtagccaattcaccagttactttctatcagctagactgctttattttcttcacctcagcagaagattttttgttcatttattgtttgactttactaactttattttctaaaattaaagccccataagagcagagaccggccgggcgcggtggctcacgcctgtaatcccagcactttgggaggttgaggcaggtggatcacgaggtcaggagatcgagaccatcctggctaacgtggtgaaacccgtctctactaaaaaatacaaaaaaaaattagccgggcgtggtggcgggcgcctgtaatcccagctactgaggaggctgaggcaggagaatggcgtgaacctgggaggtggagcttgcagtgagccaagattgccccagcctgggccacagagcaagactccatctcaaaaaaaaaaaaaaaaagagcagggaccaaatgcctattttaatacccccaaatacctagaagaatacttgacatacagcagtgaatcaattattattgaaatctcctgtgtgtgtatgtgtgcacgtgtgtgtatccatgaatcaatgaatcaatgaatcaatgaatccattaatcatccaaaattaggagaacttggggcaagcctgagacacttagggcagagggggaatgaaggttagagctgcttctgaaataggcagagtaagcagtggtataaaaattttttttgaaacatactgaattgaagcagaactgagtatcaagactttcaacaaatggcctaggtccttttaatgagtttgttggcctggacagttgtcccataaagctctctccaaaattaggtaatcaaagaaaactattaattcctgagaaattgccttgtattgcctttatttcaaatattttaccatgtcataatcatatttatgcaaatgtggcttaaacaaacttttggaacaatcccaattatttgttaagagtcacttgctattaacatgaacaaaagaaaatttaaagaggtgatattaattatatcatattaaaatattatggtcagttttctagtagcccaagagtccttggagacatttaaatagacaattttgatatctcaaagctctttgacatattaataatattgaatgttgcctcactccttaatgaggagtccaataatcttctaaatcataaataacaagtggattcaataaaataacaagacagtaactgctgatattgaaaagtaatgagaagaccaataaaggagaatgcagtaagactacaagggagagagggggaaaatgagaagaaaataactcagtgcagctgggatttcacagtattcctaatacttgtgatctagtcccacaaacaagatagaaaagacacagagaaggcaaaatgctacagatctgctttctccacacttgttttaatattttgggaaatttctgaaaatagaacaaagaggatagcaatgaaactgcagagaacaaaaggacaaagctgatgagtattaggcccagagaaatttggaaaagggaaattagacacaggagtcttaaagcttaataaagtatccctcaaaaataaagaataagaggtgtgtaactgggagtatgcatgtatatgtgtgtatttgggtatatgttgaatgaaggttcatcaatggtggctctagaaatagatcatgggaaggacttgggtgcagactgaattctaatataattttatttacagatacttaaatttgaattttacattatttttatatgtcacgtcttttaatttttttctttttttattattattatactttaagttttagggtaaatgtgcacaatatgcaggttagttacatatgtatacatgtgccatgctggtgtgctgcacccattaactcgtcatttagcattaggtatatctcctaatgctatccctcccccgtccccccaccccacaacagtccccagagtgtgatgttccccttcctgtgtccacgtgttctcatcgttcaattcccacctatgagtgagaatatgcggtgtttggttttttgttcttgcgatagtttactgagaatgattcccaatttcatccatgtccctacaaaggacatgaactcatcattttttatggctgcatagtattccatggtgtatatgtgccacattttcttaatccagtctatcgttgttggacatttgggttggttccaagtctttgctattgtgagtagtgccgcaataaacatacatgtgcatgtgtctttatagcagcatgatttatagtcctttgggtatgtacccagtaatgggatggctgggtcaaatggtatttctagttccagatccctgaggaattgccacactgacttccacaatggttgaactagtttgcagtcccaccaacagcgtaaaagtgttcctatttctccacatcctctccagccaagatggccgaataggaacagctccggtctacagctcccagagtgatcgatgcagaagacgggtgatttctgcatttccatctgaggtaccaggttcatctcactagggagtgccagacagtggacgcaggacagtgggtgcagtgcaccgtgcatgagctgaagcagggcaaggcattgcctcactcaggaagcgcaaggggtcagggagttccctttcctagtcaaagaaaggggtgacagacggcacctggaaaatcgggtcactcccaccctaatactgcgcttttctgatgggcttaaaaaacggcgcaccaggagattatatcccacacatggcttgcagggtcctacgcccatggagtctcactcattgctggcacagcagactgagatcaaactgcgaggcagcagcgaggctgggggaggggcacccaccattgcccaggcttgcttaggtaaacaaagcatccgggaagctcgaactaggtggagcccaccacagctcaaggaggcctgcctgcctctgtaggctccacctctgggggcagggcacagacaaacaaagagacagcagtaacctctgcagacttaaatgtccctctctgacagctctgaagagagcagtggttatcccagcacgcagctggagatctgagaatgggcagactgcctcctcaagtgggtccctgacccctgacccctgagaagcctaagagggaggcatcccccagtagaggcagactgacacctcacacggctgggtactcctctgagacaaaacttccagaggaacgatcagacagcagcattcgcggttcacaaaaatccgctgttctgcagccaccgctgctgatacccaggcaaacagggtctggagtggacctctagcaaactccaacagacctgcagctgagggtcctgtctgttagaaggaaaactaacaaacagaaaggacatccacaccaaaaacccatctgtacatcgccatcatcaaagaccaaaagtagataaaaccacaaagacagggaaaaataaaaggaagaaaaactggaaactctaaaaagcagagcgcctctcctcctccaaaggaatgcagttcctcaccagcaatggaacaaagctggacagagaatgactttgacgagttgagagaagaaggcttcagatgatcaaactactccgagctacaggaggaaattcaaaccaaaggcaaagaagttgaaaactttgaaaaaaatttagatgaatgtataaccacaagaaccaataaagagaagtgcttaaaggagctgatggagctgaaagccaaggcttgagaactacgtgaagaatgcagaagcctcagagccgatgtgatcaactggaagaaagggtatcagcaatggaagatgaaatgaatgaaatgaagcaagaagggaagtttagagaaaaaagaacaaaaagaaacgaacaaagcctccaagaaatatgggactatgtgaaaagaccaaatctacatctgattggtgtacctgaaagtgacggggagaatggaaccaagttggaaaacactctgcaggatattatccagaagaacttccccaatctagcaaggcaggccaacattcagattcaggaaatacagaggacaccacaaagacactcctcgagaagagcaactccaagacacataattgtcagattcaccaaagttgaaatgaaggaaaaaatgttaagggcagccagagagaaaggtcgggttacccacaaagagaagaccatcagactaacagcagatctcttggcagaaactctacaagccagaagagagtgggggccaatattcaacattcttaaagaaaaggattttcaacccagaatttcatatccagccaaactaagcttcataagtgaaggagaaataaaatactttacagacaagcaaatgctgagagattttgtcaccaccaggcctgccctaaaagagctcctgaaggaagcactaaacgtggaaagcaacaaccggtaccagccactgcaaaagcatgccaaattttaaacaccatcgaggctaggaagaaactgcatcaactaacgagcaaaataaccagctaacatcacaatgataggatcaaattcacacataacactattaactttaaatgtaaatggactagatgctccaattaaaagacacagactggcaaactggataaagtcaagacccatcaatgtgctgtattcaggaaacccatctcacacgcagagacacacataggctcaaaataaaaggatggaggaagatctatcaagcaaatggaaaacaaaaaaaggcaggggttgcaatcctagtctctgataaaacagacttgaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaacgagacttagactcccacacaataataatgagagactttaacaccccactgtcaacattagacagatcaacgagacagaaagttaacaaggatacccaggaattgaactcagttctgcaccaagcggacctaatagacatctacagaactcttcaccccaaatcaacagaatatacattcttttcagcaccacaccacacctattccaaaattgaccacatagttggaagtaaagctttcctcagcaaatataaaagaacataaattataacaaactgtctctcagaccacagtgcaatcaaactagaactcaggattaagaaactcactcaaaaccactcaactacatggaaactgaacaacctgctcctgaatgactactgggtacataacaaaatgaagacagaaataaagatgttctttgaaaccaacgagaacaaagacacaacataccagaatctctgggacacattcaaagcagtgtgtagagggaaatttatagcactaaatgcccacaagagaaagcaggaaacatccaaaattgacaccctaacaccacaattaaaagaactaggaaagcaagagcaaacacattcaaaagctagcagaaggcaagaaataactaaaatcagagcagaactgaaggaaatagagacacaaagtacccttcaaaaaattaatgaatccaggagctggttttttgagaggatcaacaaaattgatagaccgctagcaagactaataaagaagaaaagagagaagaatcaaatagacacaataaaaaatgataaaggggatatcaccaccaatcccacagaaatacaaactaccatcagagaatactacaaacacctctatgcaaataaactagaaaatctagaagaaatggataaattcctcgacacatacaccctcccaagacgaaaccaagaagaagttgaatctctgaatacaccaataacaggctctgaaattgtggcaataatcaataacttaccaaccaaaaagagtccaggaccagacggattcacagccgaattctaccagaggtacaaggaggaactggtatcattccttctgaaactattccaatcaatagaaaaagagggaatcctccctaactcattttaatttttttctaacttttaaaaatatgtaaaaataattcatagattgcaggatatacgaaaacaggtagattaggtgctcgcaggccataatttgcctctgccatcaaacaatagcataccataatctacatctgtgaattccaagggatcacaaacagaaaagcacaatggcagctgagaacaatagtggaagaatacatttttattactgttattacttattccacttatacaaatggaaaatgccatttttaaatttggtatttcctcttgtgcctcctcagaaattatactaaatttctttcagaattcatttattattaatgtgcccagattgtttcagtataagatttcttcattaaggtgatttcattttgaacagaggcaaagaaatacatttggctatttactaactataaaatatacaactgctgaaagctcgatggcacctaaaggaattgaccactttgttatcccaaaatgttctgacacttcaatgtcattgaaataatgccagagatatttcaagggatttcttttccttttcaaagatgcacattaaatagattgctatgtaaagctgatacatcatttagtcctccccaaaagggaaatgcaggtacaggcatgtttgcctcctgactcccagacaccatggctgggaaataaaacaagcaaggctgggaatctttggagtcaggcaaatctgggctctgctcaataggaagtatttgtttctttgggcaacatggagccttagttttctctccactgaaacttggaccttagctccctcacttctaaaatggaaatagaaatttctacttcccagggaaaatgagaggtttaaacttaaatgaaatgagaaagtatatgtaatattcacattgctagcacaatgtgtagaatctattattatcctcgaataccctctgtgatacacatagaaatagacacagcttctcccagcagcctagtagttggttgaaaattgttctatattcacaataaaagtcattcccagaagttgttgcaaggaaagaagtgatcctgttacaggtttgttgagacaggaagatacaagaagacaaaaataaaaatatttctttaatattgttattgggccatctgaccttagaagctagattcctgcttaaaaattcatgactaatttttagcatgaaacagcagaagtttccaattctcaagagacccactgcattgaaaatcctggggtctttttgtatggtccaaaactaatggagacaacttagcccatctaaaaattgggtgaaagagacgtaaggggggggggcaataaaaatgtatttttctaactagttttcaggtatccatattccaaaatagaacagcatctttgccagaagttcaagtcattaaggagttggtatggcattctcacttacataaagtatgggcacctctgaacaatgacctgaggattactaacaggtatgcaacatatttgaaatgtcaggtacagcaaagcaaatgactttatcaaaatataaatcacacttttagcagaaaaaccaatagttatatgaatttaacttcatctttaagtgcaaagagtaatattttgtgaattttctaaccgttttttagatgtcatcagtgtttcagaaactggtttctttcattttaaaataaagagatgctatttacttcatcattttccagccttcctgataggcgtatactcacatgaggagatacaaaactgaaaacattatctcattatagactatccacgatttaaaccttcaagctggcaatatgtatttaaataatatgtcataaacacctcttggtacataataatgtagtaaatatgagaatgcctttaaagtgaactaacttattctcccaactgttagattattccctgctatgatcccatcaccaagtgaaattttaggcatattcctctaggcaaagtaaatagttatgaggaaaaaaatattgctaattccagttgaaataagaaagcctcttaatcatctaaaatatttctggggcagatgcagtggctcatgcctgtaatcccaacactttgggaggcccaggcaggaggatcatttgaggtcaggagttcaagatcagcctgggcaataaagtgaaactctgtctctattaaaaaaaaaaattaaagaattatccaagcatggtggtgtgcgcctgtagtcccagctactcaggaggctgaggcaagaggatcacatgatcccaggaggttgaggcggcagtgagctctaatcatgccacagagtgagatactgtctctgaagaaagaaagaaatacataaataaaataaaataaaatgttctctatgggccagatttctctctgcttaggtcaattaaactacaaatttctcagtaatttttgaacgctctatctcccaagatgcctaggtggaattgttaggaagcaactgcccatccacaaaatatacctggagaatctcagatttcattcactgcttttaaaaaaggaaacaagaaaatcttcctcttagaagaaatttaatcttttaccacttttattacttttattatagaaatatatatgtatatatacatatgtgtatttatgtgtgtatatatatcagatatatctatatatatatagatatatagatatctatcagaaagcaaaacttaccttccttagacaaatggagatttggggaaattgtattggagtctagaagaataaatcctaggaaaagcaaacacacggtatacacacgcacacatacaaacctccaataaactttgggaaaaaaatttatatacacaaacactgatacacaaaatatatggattatatatgtatgtatatgtgtgtatatatattaaaatataggtttattcaccaatcactgaaaaactacatcataaactacaccaaaggagtagttttaggacaaatggcaaaaaatagtaccttacagagttgacagtttggaattgcaatacttcagatgatcacaagctttaaaaatgctcaatgtgctcgtctatgaatttcaaaatgggtataaattaaaacttattacactttttttaagttgcattcccagtacatgaaaaaacattgtcctaagactacctctttgaagcaattttcaaggattcgtgaatgagtatcgtgagcaataaactaaagctgcataagagagatatagtgtataaactgtgctagcatattatctttggttccaatcgcctcataagcattgctacactgactcaggccaatggtggtctcaaaacaatgttttcatctccctgaaccatttattcttttagaacataactcattgttgggtttcaggtgactattctgactgccattccaaggaaacaggccttctgaacaagaaaaaaatctgaaaacggaatatttcctttcagagatgtatggaaacaagctctgcctttttacccatgccataatgggtcttgctgagagtttgcttcaagaaccagaactcagtaaatgtaaacattcccttaaacagatgcacatatgttcttaatataaaatcttccagatgtaagtttcatgcaagaaagcaaagtgacctagcaagaattgagctttccatatctggtgaagcatttttcttagtgtgtgccacaagcagttattctgagaaatcatgcatctgctcctcttcacatggacattccacttctgatgagactacattcttggaaaatgtaggcaggagctgaattcaatcttacaatgtgtgtgcgcttattccttccatctatcacttacccaaaatacctgcaggtggtatcagaaatgagctttaaagggcctgtggcactgattacaaaaaaatgttaagtggtatttcatatggttgtggagtgggcagactcctgcttaagattcataatcctcatcagtaacacaagtgtatcacactcacaagataatattgaagtaatagaagaaatcgtccagaaatgcaaaaaatagttcacgtaagatgcaaaatcttatgacaaaatgaaatcctgaactaataaatagctctgtactgatatcaggccctaaagcctatattactgagagataaaacgtgggggacagcaacttagagatagggctattacattaaatctatgattacattagctaaaaagaaaaagcacaagagatgaaacaaaacatccaagaaactcatcaagatttatgcttcaagcaatgtcctaatatctgagaatatcaagatatgaggacactaacaaaagtattattattctaccggatcatttaaaaaattccttttgttctgaaatcaaataaaaagtaacaagactggcctgagtagcagaatatacatttcatactttatatttgtgtatgtctatatatatgtacctttacacatacacacagatacacataaacaatcacatctgtatttcatatctgtatttcaaccttctccattcactggaacagacatttaggttgattccatatcttgtatattgtggctaaggttgcaatgaatgtaggagtgcagatatattttcaaggtgctgatttcatttcctctggatatatacccagaaaagggattgttggatcatatggtagttctatttttaattttttgaggaagctccatacattttttcataactgtaccaatttccattatcagcaacattgtaccagggttcccttttcttcacactctcgccaacacttgttatctcttggtgtttttctttttttctttttttttaaataacagccatcttaataggtgtgaggtgatatctcattttggtttgatttgcatttctctcattagtgacattgagcaccttttcatatacccgttggctatttttatgtcttgtttagaaaaatgtctattcaagtactttggtcattttttttataaatacatacacatatgcacatgtgcacatatacatgggtatgcacatacatatgcatattttaataactatgagtactcaatgatatttaccttttttttttttgagatggagttttgctcttgttgcccaggctggagtgcaaagtcatgatctcagctcacaacctttgcctcctaggttcaagcgattctcctgcctcagccccccgagtagctgggattacaggcttgtgccaccaccctggctaattttgtatttttagtagagatggggtttctccatgttggtcaggctggtctcgaactcccgacctcaggtgatctgcctgccttggcctcccaaagtgctgggattacaggtgtgagccaccacagctggcccactttggtcattttttttaaatcaagttacttggtttttttttgttttgttttttgctattgtgtgagtttcttatttattttagagattattaactccttgtcagatagtttgcaaacattttttccaacctatagtttgtctttttattctgatgattgttttgttatacaaaagctttttatagtcccacttgtttaattttgctttcagtgcctgtgcttttggtgtgatgttcaaaatatcattatgaaggacaatatcaagaagtttttcccttgttttcttccagtagttttagagtttcaactcttatggttaggtatttaattcattttgacttaatttttatatatggtgtagataagggtccagtttcactctttgcctgtggatatccagttttcgcaacaccagttattgaagatactaccctctctccatcgtgtcttcttggtagccttgctgaaaattggttgactttataaacttgggtttatttctgggctttttattctgttccattggtccatgcatctgtttttatgccagtaacatagtgtttggttactattactttgtagtataacttgacattagggaatgtcatacctccaactttatttttctttctcaagattgttttggctattcatggtctttgtaattccacattaattttagaatttttccatttttgtgaaaaatgctatttaagtatgtccatcattctaaattaattataagagtgaagttatgccctaaattgttcattttgtaagatgtgccttgcagttttgcaccttgcaaaatgagcattaaaaattaggaacagtattttgctaatttgttcctgtgatctagaatacataattttattctatagcaggagctgtatattctcacatcggaagaaagtaatataatctgcttatatagcacatggtgtagccaataaatagcattttacatttcgtcccttttttcctttctctctcatactttcctactatttttaacagctttattgagttaaaattgacataaaataaacatcccacatttcaagtgagtgtacaatttgataaatttttggtaggaggttattgattgaattttttatattaataaccagttgttccagcaccatttgttgaaatgattatcctttgcccactgaattgcctttgaactttggttgagtatcagttgtctacatccatgtagatctttatggactctagtcatttctattgatctatttttctgagtttcctttaacactacactatcttgataaccatagttttataatgagttttgaaatcaggcagtcttagtccccaaattttgccttttatcaaagttgttttgactattctaggtcctttgcatataagtttcagaaacagtttttcaattactagccaaatgaatgttgggattttgatctggactccattaaatctacagatcaattgaggagaagagaagaccactttaacactgttacagtttcaacactgtacagtttaacatcataatctgcatttatttaggtcttccttaatttctcttggcactgttttatacattttgtgtacaagtcttgttaattttttatagacatatttcatattattgatattattgtaaaaggttttactatttcaactaatttcaattactcttaatgatacatgtaaatactactgatgtttgtatacggatcttatatcctgaaaccttgcaaagctaagttttgagttctagtaagtagtagaggttgaataaccctatccaatacacttggaatcagaagtgtttctgattttgttttttaattttggaatgtttgcatatacataatgagatatcttggagatgggacccacgtctaaatacaaaattcatttatgttttatatgcaccttatacccatagactgaaggcaacattatataatattttaataattttgttaatgaaaaaattgtatattttaaatcatcagaaggcaagtgtcaacatctcggccacccatatgagccatctgtggttgtttggcatcacaatcattcttgattttgaacttataagctactgataagcaacaattttcttaacttatttacccataagtacttatctgtaaaaaatatggcatgccatttacacagtaaaaaaaaaacaaatgtgtccagggtaactaagcagcacagcagcatcaccagaattcccgtaacagctgttgaacatcagcaacaaccaacaatggcaggctttcagtctccacctatgatgctgtgttttgattaataggttactgtgtgctgatttttttttaggtgagagaaaaaaaaaatcaaaacagttgaaggaccaggaagtgagtcctctagggatgaagaggcattttgtggatggcttttaaaaatgtttccttcagagtcatcttgcctcattaacaatggtttttgtcttagaagtctccctttgggattacaggcatgagcatgggtggatcacctgaggtcaggagttcgagactagcctgaccaacatggtgaaaccccatctctactaaaaatacaaaaaattagccgggcatggtggtgggtgcctgtaatcccagctactcaggaggctgaggcaggagaatcacttgaacttggaaggtggtggttgcagtgagccgagatcatgccaccggcactctagcctgggcaacaagagtgaaactccacctcaaaaaaaaaaaaaaaaaaaagaataagtagtagtagtagtagtagtagtagtagtagccatcgtcgtcgtcgttgtcgtcgtctctctttggctttataaactgacatgatttcttgtgctgttataaatgtacagtgctgtagtccttcaataagcccgtcacacatttttaccttatccataggaactttttcttcagtgttaacaatgtcattttaatcatcactattatcacaatcaacttgattcaaaaccatctggactatttccccattggtcaatgaagaattggaatctcattattgatgttaaaaataatcaagttctttgatatttacttctgctagcctagggaaagactctgaaattatattttttgtgtatgtaaggaggtcagacaccatctttttttctcagttggcccacagaattcttcaaagtcactaccttgttcatcaagatcacttaatatagtcacaggcaagaggttgtgccaggagtgtactactgtgtctttagtcactgcgttccaagtgttagcaatggcataaacagcacccttcatgctaaactccttctagaaaccttccacacccacacctctcttcactggtgctggcatgatgttcaagaaagtgtttttatatttactcttcatcaatctaaggataccttggtcacatgactgaattaatgaagtcacatttggggaaaagtatatggcataagcattatttttgatgaaaatttcagctgaaggatgagcagaaatgttgtcaaggaataacaaaaatctaacagttgtcatccaatccagcttccttgcagtaaccttgagcctctggtataaatgtttgtgaaaccaatcagaaaatatgtccgtggtgatccatacctttttgttaacataatagtggactgctgagaaattcactccttgaaaacagtgaggatgcaagcttttgcttttcagaacaagtttatacttttgtatgcctgctgcattagcacatgccagcacagttattgtccttggaatccttaatttttgtaggggctacctcattagcttttgtcagtgtctttctggggcaacagtaccaaaacagtgatgtttcattagcattatagactagttctggcatcagattttcatcagcaatgactctggcaaatttgtcaatgaatttttccactactacatgaccagaagatgctttatcactacaaatctttaaaaatgtaatatcatagtttttcttaattttctgcagccagcctgttgagtactcatggttcccttcaatattcatttcctcattatagatctttgcttgtctcccgattcgtattccattaagtgacaagtgttcactgcaatggtaatggatccactatttaaatacacaatcaatatttttattgttagctgtatacggtgtttttctatttttcattgacttctattcatcactttcagtataaaacttcaacagtttatccttctgtttcttcaggtcatatatggtagtcaacactatactcttccatagaacatttcaacttccgccactgtccagtttcttcttcttcaacagtttgactttctgtgctgtagagaaacataaatgcttctttttcttatcactgttacccaatactgatatcacagagggaactgcaggagtttttaatatttttaataatctttacaccatagagcagataataagaaaataaaaacacagtaatgcatgtaggtcttggccccatgtgacacattattggaaacctgccattggtgtgtttggcctgcatacatgccattttattaccctttatgagtgtgcctgcatagtgggggtggaggaatctgggtacttaagaaagatatatttcatagctgaaggggtctgggagggtcttcttccccttagggatgctgaataaactgtgtgctcagagcctgttttttgactacaccagtcacatgaagtcatgtatagaattttccacttgtggtattatgtaggtgttccaaaaagcatcttggattttcacattagcaatgctcaacctgtactagtagattccatcatattttctacataaatgatctcatgtcatctgtaaagctttacttcttcctttccaatctggatgtcatttgttcattcattcattcattcatttattgctttccttagtgcactggctatagcatctggtataatgctgaacagaagtggtaagagtgaatatccttgtcttattcttgatcttaaagtatccagtctttctgctctaatgatgtttgcattttatagacccctcttatcaagttgaagaagtttctttccattcccagtttttactttagttgaatttggtcatatttttgtctgttgggataatcatatggttttcttttttaatttgttactatggtaaccttacattgatttgttttaatgttaactaacctagtattcttaggataaatcgtatttcattaggatatgttaagcttttagatacattgaattagatttgcccacatcttaaaaataaatttttgtatctatattcatatcgatccatatatttactaattttttataatgtctttggttttagcatcaggatagtgttagcctcagagaacgagttgggaagtagtttctctgctcaattttttgaaaaataattgtatatacttggtaataggtactatttcttacttaaatgtttggtagaattcatcagtgaagccatctgggcttcaaattttctttgtgggaagatataaatgttagctggattaaattgataatgatgccgtttaagtcatctacatccttaactaatattttggtttgaatgttctatcaattattgagattgaggtgttgacatctctaaatataattgtgtgtttgtttaatactccatctttttttggaagcataatatcccttccttaacaaattatcttcttttattctatttgcacttttactttttattatgttcttttttgatccttttaagaatactggttgtactaaatgctacccatggttacactgatttttgtcttaggctttattcatttctagcccaactatatcttcctacctcttgtttgaaacagaaatattcatttttctccataaagcaggcatcccttctaatcctaagcaacacaattctcctagacacaagtattttcaagccagtcatctttgacatcactttatagaaaatacatcttctcagttaaatctttactcaagtagtgtattatcctccctctgctatcagtccctgactgtacttcatgttatgacattttaaattattgtggtaaacctcttcagcctctagaacagtatttcatacatcatcagtgtgcagtagaaacaagaacatccccaggtttactactgcctacaaaaaacaatggaaattcttcagtctatccaaataaaccagttgtcctcccttggcatcactctgtctccttccatccttcatccattcattcttccttttcttctttccttccattcaacaaatatttatactcgctcttaaatgcagctttcattcaattaatctactcattgttgtcaaaagatagcttatctttttttttttttaattggaccatatggccccactactcttcctatgcaagtcttgcaaggcccacttttagcccatcttctgaatgaacattttctgtctccaaagacagcaatttctctcatttctgagcatattattgactgtgtacataaacacaccaaacagcagtggattaaaaaaacacacagaagccattactgcctcaatcagttaaataagaatggttaaaaataatctgttgtttaaactgatggaaacaggaaggagaatgtcagcttgctttttaggctattgtcttcctgataacactggtagaaagataatcctttaccctaaaaattaatactgaattatgaggaataaatgcatacatagttcttcctgccatgcagtccatatgaaaagggggagggggtcacaacagcttaaataaaagagaagtttcagtttgtctgtaaatgtctacaccataaggaaaaaaatatttgaagccacagtaatgagagagtgtttcggtagaataaagtgtgaaatttgtaggaaggagaaccaagactgaaaatacaaaaacattattaggaaagagacattgcaaaacactataatgtgtacagttaacagaattagcagagaatataagagacacacaagaagattatgaaagatatcaatactagaaagacagaagagaatgtttaaaatagtaagaatactaatgtgtccaatttaagcatttaatgatgtttaaataaaaaataagccaccctttaaaaattccttctttattttagagttccaagataaaaatattgggaaggtatttttcaatcagtaaaacaaacttcagttagaaaaatttactattagataatcttattaatatctataaaagctgcattcatattgatttagcctacacccactttgtgcacaatgtatagagaaagaacagcttataaaattaatatctaggcaacgatggccacagtgcattttaggtatggccacttttacagtcttttgtaataattacattttaattttttttttgtcttagcaactggatcgtaaaatctttgagggcagggctccctcttacactctgtgtatcatatatagtatctagcaaggtagaaattaaataagatttcctgaattattccctggctgctcatcttaattgtaggaatccataaatgtctttcctattgattctaacatgttgggagtgccaagtatccttaagattacatccttggactagagatttaatagaaacacttcatttaatattaatagaaaagaaactaactcagagtaccaatttcttgggtggaaatacatggataataagtgacaaggtggtagaaaagcaagctacctatttcaaaaccatatttcatgtgtcagctggtgttaactaaccaggcaactactatggatgtaaacaataactacagacaacactttccaagtcttcatatcgtatctccttagaaaaaagctattatcaagcagttttgaaatccacttaaaccttttcaaaatgtattatagatttacttaggacaaagtgttctggtgcattcagtcataattggtaggaaatatcaatcaattgtttcatttgtcataatgttaaagtcactcaatctagggtcttagctgatttctcttttctgaagaactataaaacgtacaaataaactttatagaaatgggaaaatcccaagcatgtattaaaaataattcttgccactaactataaaacacatcaactctggcaagagcctttcctggggagcatagtgtacaaggtctagatgtgactatcatacagagcttttttggcttgccaatgctgccaaaaaaaaaaaaacaccactgactggatgtagcttaaacaacataaatttattttctcctagttctagcggctaaaagtccaaaatcaaggtgttggcaggtctagtttcttctgagacctcttgtctttgcttgcgggtggcggccttcttgctctgtcttcgcatggcctttcctctgaactaacacacattcctggaatttctgtgtgcccaaatattctcttcttacaaggacactagtcatgttaggtaaagtcccatcctagaagtctcattttgtctcaattaccccttgtaggaccctatctccaaatgcactctcattccaaggaaggtgctaggagttagggcttcaacatatgaatgaggaggaggaaggaagagatacaattcagcccataacaagaggccagagagctgtcatgaaatttcaggaaagatatagctctctcaaataatatttttactgagtatcactgaatttagagccaaaagagacctcaaagttgatcatgtctcaccacctaggcaatgctgaaatccctcgtaaggttgtaaggtttcactgactagtctcagcctctgcttccttatccagggaattcaccactaccatggaaatagatgccatttatagagagttaatcattgtgtggtgggataataattttgaaatatcaaccgttttttcttttccatttttctatcttgtattttctcttttcatcaactccagtgagcttttattctatacttatcacctcaccaagtgatatacactagaagcttttagtgtgaaaacgtctaggccccgtaaagaccaggaaggatctggcatttgcactctccaaggcctgaattcctctagaccaaattcataaacacagcagcagaaccttatacacaaccttatataaacttgagaaaacctaaaatatagggaaataagatttcagggtagaatggcttgctctgtgtctgtttcagggctctgtgtctccttagatggacctaaaacagtccacggaatttcctgtgcttggatgtggcacaggaaaatgaatcccatcttccaaaaggggccttgacatagctgagataggacttgtagataggaacaagtattgattcagtagcaacttgcatgggtgaatgactagaaaggataatgagtctcagcaaatgtcagatgaaatggaagcataaaggtcgtcatcccttggcaatatggaaagccccataaattagagagctgccaaatggctaaggtttagtttttgccattctgtctcaaaacagaaattatttcgagaaaaaacctctattttttgaatacttgggtttatgactaccattaaacaaaaatatttattccttattacttcttcactcacttatattgattacaaaagtatgaattatattaaaagttggtgttgtttattacaaacaagaattgaaatgagatcaactagtatatttgttcttatacgtaggtgacacacggtcatttcaatgcccactctttaagaccccttgggcttgtaaaacatgaagtacatattaagaggtgtgaatatgtacaataccaacaaacatggctgattatgagcctcccaaacattctttaaccaaatcagaaccctaatgtgtaaatttcgctgttgtagtaagaaatatacaattatgatatttgaaatgctattagaaattaagaaagaaactaataacactatacgttgcttttgaccctaataaaatactcataaaaataaattggatgtgtcaatgtgtccatcctttgagatcaaggccaattgtagcgacatagaatgttgaaactgaaagggttcttagaagccatctggcaaacactctcataaacagatgtgagaattgagatccagaaacatgaaaagatgtgtttagggcaacagcagtcactggcaaatccagtgtggaagatggtgtcttcacacattccacttctttttctgcaggcatctcaaggtcacagcagaatcatttcttcaaggtttccttactcttctataagggcaatcacatggttgatgcttatttaaaatatttaaaactatttataatcatgaatgaaatttaaaagagtcaagacactagctaacccaaaagttgggcttttcccttttgagaaaatatttttctaactgatagaacatttggtttctcaacttttatctatcattaatgatatgctccactgctagaatgatggaatggcctagattgtttagagtacacgaaattatctttaatgaagataatttcattatctttgtgataatgaagaattagcctatctttgtgataatgaagaaataaagatttcttcacaatgataagcttagttgaatttagaaaaattaatatgtggctcctaaagcattcataattatatataaatctctttaataatttttttcctaaagttatctctgtgataatatatattctagacatatattcaaatatatttaagatatattaaaagtagtaattttaaatacagtttgaggaaagaattaaactctgagatatttataattcaacattgaaacaaatcttaaaactttgtcatgcgcttgttacaattacagttttgtaattctgtttgcatcaggtatgttgcaaataataccacctctttattcatttagcactttctatctataaaacatcttttaaatatactactaatttcatccatgccttgctgtagaatctttaaaaatgtgttagcagtttatgcagttttttcttctagttatagatcaaaagattcagagttagccacctgaggtaggcagtgtggaaacctactctcaaatacatttttggtgagtgaacataatcctattttctaccaattgacacaaatctcaaactgatttgttagaacatgtattctgcaatagtcaagcaatacaggacctggaatacacaattagtctcttcaagaaactttttcagcctttcaccgtgaacaagaaacaaaaaaaaaaaaaaaaaagtaagaaacttcagcaagataaagaacataaactcatcatgacctttagcttcagaaatttcagaaattttaattgaaacattaaaaaacagctatatatcatgaaatatatgaatttaagtacttgaactctctaataatgtatcttcctaggtgtccctcattcatatgtcccattattcagtctgcttttgtcttccttgtgcttctctgtgttgcttctttacccattcaacaacataagttaggataacttggtgggcttttcttttttctttttttgttttcttgagacagagtctcactctgtcatccaggctggagtgcaatggcgtgatcttggctcactgcaaacttcacctcccgggttcaagtgattctcctgtctcagcctcctgagtagctgggattataggcgtgtgccaccacacttggctaattttttgtaaattttagtagagacagggtttcaccatgtctggtctcgaaatcctggtctcaccaggatggtctcgaactcctgaccttggtgatctgctcgtctcggcctctcaaagtgctgggattacagaagtgagccactatacccaaaccttactttcaaaagttcttacctttcttgtgtttttactatttagaatatttggctgaagtttttactctttctttttgccttccccaagcctaggccccagccatcttttctgactgctcccatttttgctaggcaaaacctagcaagaacctcctttacaccaaaaacaaattttcctaatgctctcttgtcaaggtccaacagtggtagagctgaaacagagccaatggagttgtttatatcatccagcttcgtatttattagccacatatgtgctgcaaatcttagaaagggaaggatggtgctaagttctctgcagatgctcaaatgctaaataataaacatgtgatacaagctgagattcacaataaagacagggaatatccaaaaatatgtacttcaaaattatatcagttatttcccctaggcagtttagaatacaggattttaaaattcttgatgagtaaagagggaggaattaaatgataggcaaacatgtagcctgcatattgagtaagaatttattgtcccaaagagctgttatcccaaatcagctggttctgatatttcgatattattcaagaaggtagttagtcaccattttaggaatggtttaactttagctgaaactgattagcagttttttctgaatataaaatatggagaagttattaataaatgtcaaatcagtctctctcttaatcgctctcactctctctccctctctctctctctctcacacacacagcaagagacatttgaatataccatcaactttcattggcttactaacgctatggcacagcagagtgtgtttctttcctttggagctctatagtagcataagaaaaccttgctgaaaattgagcaacactttttcatgctgaatgattttgttttacatttcctctgatacaaatagaaaagacgtctcacattcagctacctatgctagactacaccacaaataagctcatacctttataatgtgtctacatgacagtaacaactgtggtgagcatagaattattcatatgcctatacttatttcctatgtctttacttaacatctgggaaccactctcaaggtagtgtctctggtagttctgggaaagctgggtgcttctgtgttactagtatactaagaccttaagtaaggggtcctcttatgctctagggacttctctaacctctctctgaaaccctcaaggtaacagagctttagttccacacaggaggctcgagaaccacaaagctagcaggctgctatgatctgggtctctctaatgcctgtgcccgcccatatcttattctccttctcaacagacagaaatgagttccaaaatcttttcaaatcatttcttcctctggcaatattcaatagcagggccctcaccttggttcctgcaattgcctcacttcccatctctcctaatcactgtggcttcattccttttcagttttggttcccaaagtaactctaaccagggatctcttttatatgacagtatttagcagattggtattttaaatgttttagagtgtggttcctggcaggcctttttttgttgtttggtttttgtccacagtgtgagcaataaagatcttaattaaagaaattaatgaaaatgtcacctagagttggaagctcaattcacagtgttgggttgctggttccctactaatagattatatcctggcaacactgtcacagtacagcaataaaaactgttctggcatcttccaggtccaccacagagtctcattcttgctgttatgtctggactgaactcagagtaacccagaatcttcctcatacaagccttgtccacctatattctattctcgaatcatatctgaatcagcatttaaaactcaagtcactcctcccaataaaaccctccagtaatatcccatttaatttttggcttggcttataactttcatatatttacatatttcaacatatggaaggagacaccttcatttatactcttgccctggttcattcaaacattaagggtgaacatgcatcctgctgcctgttaaagagagtaatattaattttactaagcctaaaataatattttaaagtataaggacatactacagagaaaatcacatgatagaatataatgaagtaaaaatacccattctgaacagatctaccttgtaagagagtaattaagttaaaggcttgaggcactctccaaagaggagaccacacccaaaatgatcgaatcgtgatggtgtattgactgttattgataaataacattagcatattaactatatttacctcaaacttttcctaatggagctagtatattctgtaagtaaataactttccctcttctttggttcagcacacccaaagttcagtaatccagttgttgcatgatattcaattaaattgcacctttacgccaatgactacaattaaaatggaaatccattctctttctctctttctctagattacagacttgggctctttcatacattcaaaaacaagcaagccagatacacagttatcctcaacacttgtgtcttccttatccagaccttgcaaattcagttaggtactgtttctcaaaactcttatttagacccttcatcactgcttccataaaactccctttatttttccctgctttgttgcagtaatcccctatcttgtctactttctgtagattcatctttctaaaccattcaccatccacctctgcttttttgagcagtgcttcttaaagtatggttcccgtatcagcagcatcacatcactcaggagttgttagaaatgcaaactcttgggttccaccccagaactactgagtcagaagctctggaggtggggcccagccatctgtgtttcaacaagccctccaagtgattatcatgcattttaaaatttgaaaaccaaggttctaaagtcatatttttaaaaggcaaaaccaatcatgtcatttgcttgcttaaaacttctttaatgagtctcttctgaaggataaaagccaagttcttgggaagacgtgtaataccctttctgttctcatatttcagcccttctctttccacttcctccttcccacccagtgttttagtcatataaatgttttgaaatattgtgaagcaacctgctttttctgcctttttgccttttcctagtgcacctcttcccacacacaattcatccacctggaggggttccattcatctttccagatcaagctcaaatgtcccctttttcagaatgatttctgagggctaatttcaataacttacttacagcctattccacttcttccaggtccacctacataattttcccaaattaaatttttatacctccagctctttaaaaggaaagaaagtctgtttactgggcaaggaggcataggaaaaaatataaagggcactgcttatcccacctcacatcctcccacccctagttcacaagttaaagattgtcatccatctcttggaatagttatggctccttaaggatgttaatgccccctcctagatgttgtctcaattgtttattggtaagcccactcctagatatgcaggacccaaagcaatagtagaaagggaggcctacataccacatttaaatatttaaaagttatttaaaaactaagaaactttaataaaatatgttctatcattgtgctgccttaaatatataatttttaatgacaaatgaaaagtattatgtaaggcaatagtttttagataactaaaagctggcaaaatatcaaagatattcagtgcaatatttgatagcatacctgggcattctcttgatgagatagcaatgtttaggtaagtaataaaatgaaaccagcttaattcataaacacacatgtgttccataaaatttatatttctcctctttatttcatcaaaattatattgctatggtcaagatttttaatttcttgacagggatgagccaaaggatttaaaataaaatgaaattgtattgaagttagaaaattcaaatatatttcattaaaaattaaatataaaaacaaaaataaaattatttttttcataattcttaaatattcaaattatctattaagtcaaaaactgaaatgcatataaggaatatcacattttaatttcagaatatttcattaaagctgacattttctcatttaattttgtctcatttaacattgagcatccactatccatttgcttgccaatatgaagaattggtagcacacttcatacttattttctctaaccctacatatagacaaatgtaggagtactatgatttatttaataatccaaaatatacttatcgtgtacaaatgttatgctaatttgtctggactttcaaatctaccaatgaaacatgaacagatacaagaaaatggatgttcagctctacccaggaaaacaatcctcgattctgcaatgatttggtgcgttcattccacaaggaagaatttgaaaataatttatgtatattttctctatagtgctcaaatcctagcccaccccacccacctgctgcaaaataagatgttcatctctcatattgacagcagttcaaactgcaaatgttcatggcatttgagctttgttatctttttgctactaggatgtaagaaaaattgtggagaagaattttccggtagcccgagtaatattaaccacgagagtgaatgtttagagttacagattgcactgagccagtgctgtaggccagaattgaggcaacagaggcatttatgtttgtgtttttgtcatatgtggggccctctaatgcatggggcccaggacaaagacctttctttcctggatctaagcatggcactacctaggtgtttgatggctttaccctaggagtaaggttgagttttaaggtgctatcctagggaataatttcaatatatcttggagttggaacttctatacatttgcagtgcgtcacccgactttggtctatcaaagcaaaaaaacttggtcaggctttggtgcctagctatctggtcaaatatttatctaaatgtttctgtgaaggtattttacagacgtggtgagcatttcttaatcaactgactttaattaaagagtttacccttgataatgtaggtgggcttcacccagtaagttggaagccataaaagcaaaagataaaaacagaaaaaaaaaaaaacagaaaactgaggtatcccccataagaagggattctgccttaagactaacatagaaatcctgcctgagtttccagcctgccaacctgccctacaaatttcagatctaatattgcaacatcaactcttgcctgagtttatataaaacctacgcgatagatttcagacctgccagcccccgccatgtaagccaattccttttggaggaccccgactgacacaggtaaataattccatcttcttttatcccagtccccaaaggcagataaagaaaatgtaaacatatatatgtactatataccttatctttataccttctgatagcacgttggacaaaccacggtttctagaatttatggcatagtattataatcataggtttcaaagtctgtctcctattctagactggaagttccttgtgtgcagaggctgtgttatcacagcgctttttgaggctggaaataaacgttcaatacatgtctgtcaaaggttagagaatcaaaattaacacattacctggataagctggcatgtggtggggacaggagtaggggatggtggaagagcaaggagaaagaatcaaacaatgtggacgtaggaagcagtctccctgaagctaagacaccccatgagatggtactcatccagctttgccaagctcccagcacagtcttaatcacctctctcacagcgactttgatagctctggctaaggaacttgatacctgcaagcaattaactttaataagccagcaggtgatttccttgagaatgctgacgattcaatttgctgacagcagctctagattctctggctactcagccatggcttctacctctgcccttatgaacccagtgtgtggttgtgagtaataaatgaaaaggtagccaaagtgtgaatccttttaacagtgaaaattgtaatcagctttaaggcatgattatatattacagacagaaccaaaaggtcttttaaagttatgaagaaaaacaaaagccaacaagttgtacagctacattggcaccaaacttttatagtttctgtgaatgtgaaatgaagggatataaaagtactttcacctgtattaaccttttttttttctgttactcatcatagcattatctaacgcagaatcctaggaatgattctaaactctttctctctgtctcaataatcctaaatgttgcaattgccttattgtcctattttactgcattattttttacacaatggcagcctaatgagttcccccggcatcagtctcaggcatcacctatcaaacaactccactgcttgcgtcctcttcccaaaatgcaaatattatttcatctgcatgtaatttcttaatagttctccattgttaattgactacagtggagtcaaatcttagaattaaattttaaggaaaaagaggcaaaagagctattttactcaaaattaacactgaatatttcttaaattgtccaaaaaatacagtatgctccccattatatatgaaactgtgcagcaatacatgtttgtatatgtagtaatttatggtaaataaatttataataaaactgtaatattataattaaatataataatataatgtaaatatcattaataatataataaaataaacttataataaagagaatgtaagctttgtgaggacagtgattttcattcattttgttcaccgatgtaccccaaaggccaaaaactgtgcttgtcatagcaggtgatcaatgaatacttgttaaatgaaaatcacataacaattgattaacaccattttaacaattgatttgacaattgttatgtcactgacaattgtttgttaaaatcatttcaaataactttattttccctttttgtgcaacacatttaccactaaagtaacatagaaagtctgtgtgtggtggaaagtcattaatttacattgctttctaggtactaccgtcttccatgatctgcgctatccgttctgcacttatactttgacttcagtgtatcaaatcactcaatgttctccaaatatgctgtgcaaagatctttgcactttgattcctcaagccaatttaagtgtcctgtgatcttacgaactttgtttttcctctattttcaatgtttatttcattgcatttttatcgttttcttgtgggtctgccttcttgatcagattctaagactcttgattataaaatctatgtcttaatagtgtttttaatagtgtctctagtacaatgtcggtgtatcaatagacacatacagagtatctgatttatattaagtgtttatttgtctgtctgtgccattatgaccacatatgttacacttgaactttctgaccctaagttaacatctgataacatgtgttctacattttaggagcaaaagatatacttaattatttcaacaaactaatgagcaaacaattttagtatcagcctgcagtaaatactctttgatccagtatccagaatccagtacacagtatccactgtgtagcagcttctgcacatggggcatcaagggtaccaccccagaaaaactgctatgaccagaagtattgcagagaccagggtaaccagaagcacgatcatctcagaatatacctgcagcagcatgcctacagtggccttatatggtttgtgggcaagagaccattgtgaggaagtcagagaaacatatttgagtcactttgttcctatgcaaatatatgcctcccagagatcttcttgagttggcagagagggactttgctgtgggagaggggagatatgttttttggcctcaatggtagcagctaggcaccagtataatttgatattaatctagatgcctgcatttcaactcacctctcaggcgggaatatggactcaggcttttagaaagctttttcacaatgggggacaaagtagcaagtgaaagaaaagggtaaagtggaaggaaaaccttttcctgatggttaagcagttcctaacttacatgtatgaatgcatacatacaaatataaatactagcttaaagaagaataccctatcccatgcactccaggtaattaaatgtttatttcactctgatttgagatgtctcacgatgctaaggaaaatattggaaagaccttctctctcgttatctcaccttcagttaaaaaaaaatgaaagagagaagaagagagaaaagagataaatagaagggctatttgaaggtaagaaggtgaaggcagtcaccttttatgccttcctcccttcctcctgccaatcatccactctatttggttgactcccaagcttgctttataaacagctggagagcaaagcaaaacttcaactttagaaagataaggtcaactcatcctttcatttgcaacaagttgatagggccattgccgtgcaggtttggctggtcctggacaaaaccgccttctccagaatgggatttagaggaagacccttctctctctaatgtgactgaggaaaacagaaggaaggtaggcaaaggagatctgctctaggccaggcacagtggctcacgcctataattcaagcactttgggagactcaggcgggtggatcacctgaggtcaggagttcgagatctgcctggccaacatggtgaacccccatctctactaaaaatacaaaaaaatagctgggcgtgatggtgggcacctgtaatctgagctacttgggaggctgaggcaggagaattgcttgaactcggaggcagaggttgcagtgagccgagatcgcgccactgcactccagcctgggtgacagagagagaccctgtctcaaaaaaagaaaagaaaagaaaagaaaacaaaaagacctgctctccagtagcctctgaggccccaacttcccagaatgggagtgttgatcaggacctatggtaaatgtttcctactccagtccaacagctcactgggctaaacaaaagaggcccttcacagcctcggggcagacccacaaatatttttatttaattggtttgagatggggccacagactttttggactggtccccaggtgaatcacacgtacagacaaaattcagaagcactgggttagagggccagcatgagggctagagtgagagttcagatactgcagggagaggctatgggatttcctcacggaaagagacccaagggtgtggaaggcattttctggaagatgactgaggtacttggttatgggcaagacagtctaatttacaaaaacatgataaacctctcgagcaaagcttttcaagctgtgcaccccagaaggtgtgcaagatgagccatgacaacatataagaaaacaactgaatgtaacatttccattctaatttttataaaatttctttgttttacttattagtatagtagtgcatatgtattatttataaataaagaaacatttattaggagtatagcctcaacatcattttactaatgggcataaataattctaaaatttggaaactagtgttctaaagaaggaccatgattcctcactgaaggctcagctgagaaagctgtgataaccaggcaaaccagagaggaacttcatccagttgcctggtaagaatgatgaatattctgggttgctaagaaaatacatcagccagaagggagcaagagaggctgccctgctggggaatgtttgggagaccataaaaacagaaggtgggagcaacgagagggctcttcatcgctactgttaataacaaaacaatagcaacaaatgtaatacctgctcttacttactgaattcccagtaaggtcaagcactgtgataggcactttttgggcatcactgttaatcctcatgctgtcatacccattttacagattaggaggaaaaaaacctttaaaaaccataagtggtgcaacacagatattctactccaaactcaatgttcctgacattatgtcatgcagtttcaagagcatggatcatgagtgacattaggaaactgagagaagaagcatattatagcacttagagggtattatagtataaccaggttgtatttatcagctgtcttttctttcaattaaaatgctaaaggccgggtgcggtggctcatgcctgtaatcccagcactttgggaggctgaggcgggtggatcacgaggtcaggagatcaagaccatcatggctaacatggtgaaaccccgtctctactaaaaatacaaaaaattagccgggcgtggtggcaggtgcctgtagtcccagctactgaggaggctgaggcaggagaaggatgtgaacctgggaggcggagcttgcagtgagcctagattgcgacactgcactccagactggacgacagagcgagaccctgtctcaaaaaaaaaaaaaaatgctaaactgtggttgatgttttcataaacagagaattggtgctagcttcccaggcaatttgagagaatagattttcctgagtgtaagtaaacctacaagttaaaagaagtgacatccactgggagactcaggccaaatgtgatttcttccatacaaagtcaggtttatcaactccctccccccaccccaccacacacagaaacacacttttaatacttgcttttacactctgcatctgtgttcactttttccattgaccctccaaccaaatttgtggttctaaagctctgacatcaacagtgcattcctgagggtacttctctaggactgtcttcattttaagtctttgctcataggcacaactgtaaacttataagaagtttcaagcaactgtagagtaataagaatcagatctgtcctggggttgtggcgggggtgggcgggggaagtgtggctcttgagtagacagagacttggcatgacagtccttgtttaggattgggactcaagagattccaggaaagtcagtgtcccttccgtccaatcacagtgtgaggcccggtgattctggccttttctgctctatcattcagaaatgaagtcttttctgctctatcattcaggaaagaagtcttttctgctctatcattctagcttcttagccaccttgttggtttttatggattttctttttaccctgctcctgcctagcaagaaagaataaagaaaagggagaggaggggagagaaaggagctgactctgcagaccacaactttataattatttgaatataaaattagctggtaatgtctctctctttatgcaggctatgagatacatgatagttgtttctagtaacatatgttttctcatttttatcttttgaaatgttgttgaagtattcctaacttttatggctattaatggaggatgctgctaccatcctacccaagggcccatttttctaaatcctacaatcctctacgaatggaagcaatagcactacagttaacactctaaattgtacccttgtgcacacatacaggcctaaatcacttggccttatagccacaaaacacaattaggaaggactaaggtcatcaaaaaaaatcctaaatgccagttcactgcacagcacattctatagtcatcttacttacttgttcttgataaaaatgaatcccagcagggactagaatggtgaccctgattgtgaataatggcacacatgcagtgtccctcaatggctaccagaaaacaacagcatcagttaatagcctgtgttgtctcttaactgcccattgccagcaataggttttgctctatatagtctggattcccagtttcaagggtcttcactcctaccaggcaaaagtgctgtaatgagaacaagccaagaaaggaatgaggcaggcaacaagccaaaatccaggcagtgttagaacagccttgtcagggaagcagagaaacaaataattgaaattagaaaaaactagattttcagaggagtctcataaatcagacttgaaaatttaatttgagagcttttctctttctttcatcatattttttcccctcctggagctgtgctacaggcctgaacagaggaagtggaatgtaattaatcgatgtaaatctgcttcattaatggattgctactccctgtgtttcctctagtcaagaatgtttctgaaagtgctctctgacaacaatgctattcacagtctggataatggtaccaagcaggagaagaaacgatgaagtacttgcatgaagggagcccatgtttgctattgactggtagagaaatttagttagctcattaaatgttctgcttacaaaccctattcatgctttttaatcaattgatacttgtcctcctttctcacattgattaaataccaggaagtcctcacaagatagtgagatgtgaagttcccattgcagttaacaaatggtcctaagacccttagaaaacacatggttgtgcatctttatgcccacagggaatacgccattaatctgaactaataaagaggaacagcaggctaatcatagctcatttatatttggccctggaatgtgttatgtggtttttggcagaagatttaccttactaattatgtcttacttaaattaataatacagttaatttgcattcccttagcacacaccaattgacagtgagaagaaatgtgctaagtgataaggggatatcatctcgaaatttaaaagcttcattgaataatttgtgtatatatgtatgtgttgacactatatacatttaggacaaaaactctcaacatactttggaaagagaagttaaaattatgtgtgaaaatcgctatcaccttttggctaatttgcatcatcattgtttcaatattttatctcactacttctgagaccaataaattagaaagttaaacctgtaatcaacaaatatgtgtatatgtaacctaccatatcctgagcactgttctcagtattgtaaagggatttgaagaaatatacagtcattactctgtttcaaagtggggactggttccaggacccccatggacaccaaaattcatggatgctgaagtctctgatataaaatgatgtagtatatgcacaaaacctatgcacatcctcctatttactttaaatcatacctagattacttataatttataactcaatgtatgtgttatgcaaaatagttgttattgtactctgcattgtatagggaataatgacaagaaaggaaaagtttgtacatgttcagtacacacacaactactatagacctaaccacatttttcatctgtagttggttaaatacatggatatggaacccatagatactaagggccaactgtaggctattttctatcttaagatctaaaaatctggagaaagaaatattaagagatctagcactaatatgctttaggtgatctttgccttgtttgtagagactacaactcatttacaaaccatctcctatagacctggattgctgatgtggggaagaaaaaattaaggggtttacctttaagcagagtcaaggaggttaagaccaggtatctgattttccagtaaatgaagttgatgaacacaataaacccatgtatcattgctaaagtgctgtaaagtagagctttaatgccctctgtcaacttagaatcaagagtaaatatccactagcaattctacactggtataacaacattgcccagttactccacctttgaaatcttcccagacggacagttgttcaccatggcagatatgaagattcaaatatgtttgagctatacgaagtacatgataatgtaatgttgatctatctggttttggatgcatgaagcaatggtccaaacttggatatggaaaggaaacctcacttgtttcacaaatcacaggcatatttgtttcagatattgtaacacaatgattttcacccctctcacttttagcacaagtgttgcataagacccttggaagttggcctaatactagagatatcactaagtcttttttataatctatttctgattaattagtcctttaggataacatatacttatcaatatcattatgacattgcaggaaaaacaaaagcggtatgggtggattcatctcctctaaacttctttctttatggtcttgaacaaattactaaattgtaatgagtaaaatatgtatgttaatacccacattataatgtagttataagagctcgacataatgtatgttgagtgcttttgcaaagtgctttatattttagaaatactctccttttagtgcagccatactttgattctttttcattgcaatgacatggaaatttcaggacacaaaaatcagagtggccaaagaatttcatgggttcctttcaaaggataaaacaggaaattagaaagaataagtatgatataattcaaaatgtaaagccaatatctcgccaacttattaatacataaaattatatgccaatcttaacagaaatgaatgctacaacgtggtttgctaagctaattcaataggactacattaataaagttcctataacaattgagatggtaatctcatgttacagttggctagtctggccaatccaacaatactacattctattttgaacatcacttggagtggtattaccaaaaaataaactggaaagcatttagacaagaatggctcagacaaggtaagagctaaaagtaaccatttgaagggactataaaattcacctcagagaagagggagcatatggaatacatgagggctgacttcaaatatttcaagagttgttgccaggaagaactttaaacatagagtaactgatgtttaactcatgccgtgaactcatccactgtatgtttgaaaaccagtagcccagtagcctgttgggaagacagatttgtttcatatgtaagtaaagacaattcttcttattgaaaaaagcatggacataagatctgataaatccagcagaaaatttcaccttcaatcaagtagcaatgtgaccctaaatataaaacctctttgagcttatttttccaaactataaatcatgtcaacaataaggctgatacaaggattacctaagagaacatgtttaaaagcaccagcataatgctttaaatttcatagatgtgtaacaagaactaattctaacagtcatatgtcaaagatgttcaaagatggaattgagtgttatgggagacaataattttcctatgctagaaattgtttaggcaaaggctaaataaccacttggaagaatacaaaagaggaaagtcaagcttcagaattaaaattagattactttcaggattcctttcaactctaaatctgaagatcttgtgatacaaacattaaaaaaaagtttgcctaggaaaaaatatcaagaatagcaacagttatatctacaagagtaggtaaaaattgactaatatttgaaaaattagtctagctccctattaaagtatatagtttattactcttttaaactagtcaaggggaaaaaataaataatattggtaaaactcaatgcagatcatatttcattaaacaagaacatctttctttgccagatgtataggttagttatacactttcagaggatactatgataatgatcatatacaataacccagttgtcccattctttgatattaataattaaagcaatatttcttttggagaagttattcctttaaaaattcaactggtaggataaatctaatagagaagtagcacacagctaaaaacagaagttttagtaaattaatgagtggaatgttgaattcagcagtagctttaactaatgttgtgaactcatccactgtatatcagaaaaatttacagtacgttagaaaataatttgtgaaaccaatagcccagttgtctaggaacaaatgcacatcaagtaatagggaatatttttaataaaatttagtagattatggtgtaaggttttatacacaaatgtaaaggttttaattcaaatgtgataaaggagatgtttgtggatttatttagggtataaaaagccacatttttaatataaaactttattaatgtgacgaaattttggaattaaaagtagtaggacgcttacatcatatccctcactaaatgaagggcgtattgtttatgaaataatgttacatgagaaagaagacaatattgcacatacatattaacaaagtccttagctatccataaaatctagtttttccttcattactagtaacagatgtgtagcttttgcaagtggctaccagaaacactacatttcccagtctagcttgtagttggaaggaatcatgtggctaatttcaggagaaggtaagcagaaataatgtgtgacactgatacctgtaagaccagccctgtatttttcttgtacatttaagttccctgtacactctggatattagacctttgtcagatggatagattgtaaaaactttctcccattctataggttatctgtttactctgatgatagtttattttgctgtgtagaagctcttcggtttacttagatctcatttgtcaatttttgcttttaatgcaattgctttgggtgttttcatcatgaaatctttgccccatgcctatgtcctgaatggtattgcctaattttcttctagcgtttttatattacagttttgggtttttcatttaagtccttttttatttttatttttatttttggcagagtctcactccgtcacccaggctggagtgcagtggtgcaacctctgtcattgcaacttctgtttcccgcgttaagtgattcttgtgcctctggctctcgaatagctggaattataggtgtgtgcaaccatgcccagctaatttttgtatttttagtagagacagggtttcaccatgtttgccaggctgatctcgaactcctgacctcaagtgatctgcccacctgggcctcccaaaatgctaagattacaggcatgagccatggcatccagccttatttaagtttttaatagatcttgagttaatttttgtatatggtataaggaaggtgtccagcttcaattttctgcatatgactagccagcactctcagcatgatttattaaataaggagtcctttccccattacttgtttttgtcaagtttgtctaagattagatggttgtaagtgtgtggtcttatttctgagttatctattctgttccattggtttacatgtctgttcttgtaccagtgctataaaaagtggacatgaacagacatttgtcaaaagaagacatacatggagccaacaaacatatgaaaaacagctcaacatcactgatcattagagaaatgcaaatcaaaaccacaaagaaataccatctcatgccagtcagaatagctattaaaaagtcaaaaaacaacagatgctggcgaggttacggagaaaaaggaatatttttacactgcaggtgagagtgcaaattagttcaacaattgcggaagacagtgtggcaattcctcaaagatctagaggcagaaatgccatttgacccagcaatcccattactgggtatatacccaaagaaatataaattattctattatgttcacagcaatgtggatggaattggagatcattattctaagtgaagtaactcaggaatggaaaaccaaacattgtatgttctcacttataagtgggagctaagctatgaggatgcaaaggcataagaattatacagtgaactttggggactcaggggaaagggtggaagggggcgagggataaaagactacaaattggatacagtgtatattgcttgggtgatgagtgcaccaacatctcacaaaaacaccacaaaagaacttactcatgtaaccaaacaccatgtgttcccccaaaacctaaggaaatttaaaaaattttaaaatcattctattataggccaggcgtggtggctcatgcctgtaatcccagcactttgggaggctgaggcgggcggatcacgaggtcaggagatcgagaccatcctggctaatgcggtgaaaccctgtctctactaaaaatacaaaaaaaattagccaggcgtggtggcaggtgcctgtagtcccagctactggggaggctgaggcaggtgaatggcgtgaacccaggaggcagagcttgcagtaagccgagattgtgccactgcactccagcctgggtgacagagcgatactctgtctgaaaaaaaaaaaaaaagatcattctattataaagatacatgtattcatatattcattgcagcatgagtcacaataacaaagacatggaatcaacctaaatgcctgttaatgatagactggataaagaaaatgtgatacacatacaccatggaatactatgcagccataaaaaggaatgagatcatgtcatttgcagggacatggatggagttgaaagccattatgctcagcaaactaacgaaggaatagaaaactaaacactgcatgttctcacttataagtgggagctgaatgatgagaacacatggacacattgttggagggaacaacacacactggagcctgtcggcatggggtggggacagggagtgcatcaagaagaacagttaatggattctgggcttactacctagatgatgagatgatctgtgcagcaaactaccatgacacatgtttatctatgtaacaaacctatacattttgcacatgtacccctgaacttaaaatttaaaaaaagaccagtcctgtcttttcacattcccctgatctcttcctatgagctggaataataaaaaccagagtgatcttttatatcacatggtgaataaggcagaggcactaccagaataagaccttgagtgactatgtggaaggaaggcactgctaacccagaatactcatttgcaattgttatgtgagaaaaatacacttctatcttgtctgagctattgaatcttactttatttgtttcagtagtttagcatttgaccctaaaaactactctgactaaaactatgcaaaaatgcatgtttatctaatcatagagataacaagaagccctaggaaagtacaaagtgattgttttaaggtaatattttataaaatttaagtattttccaattatgtgacaacatttcttttggataattattatggatcagtcaagggccaaatacacaataaattgttcaatagattcagtcttcctctgaaatccaaggaaggccatatataaaaacaggagcaaattgctaggggaattcatatttgattcctaattgtacatttaccagaagaaaatttggcatttgaattgagcatttaaattcactactattcaacagcaatctgaatccccaagttcaattaaaaaggtcattaccctctagaactggaggtgctcttttaattacaatattgctaatgaattgggagacaagacattttggcttagttcaattagcacatttaagtcaaagcaaacttcagccaatatgggtgactttcccagtggcatgctttttctttattccctccttccctccctcccttccttctttttgtgtcttccctacttccttctttcctcggaaatttaagcataactctggcacgtaagtctctcatttccattttatctgtaaactgctgcaaagctgttaatagctaaggacctacaaccacatttttgttttgcaaaactcttcaaatttatatgaatattgagaaaacattttgatgagaaatttttaacatagctttctgaagcagagtaaaacataaatttcactttccctagctaaaacaataattatccaatcactttatcatggtgtattgcacatgcttttgctatgggaaagggggaaaagtgaacatatttaacactttgctaccaacaatggtttattgaggttaatttatattaggaaagtggagtttccggatgacattccaaactaaagaatactaatgaatagctcctgagctctgagctttcctgcctggctagaattcacaggacatgaccttaaatgtaacagtttttggtaaaaaagagaaaatcttcccttcaaagtgatttgaaaagttcagaaaattagctcttatgctcaaactaatagtaacaaaaacactgctaccagattaaatttaaataaagttcataacagctgtttgtaacatctagatttaactttaggggaaataattgactcaatttgcccaggttattctcttcctttgctatgccagtaaagggcttggagaggttgcccatgcaacatatcctacagatttgagtcagctagactaggtgtttattcatttattcaggaaatacactgagcagcctactgtgagcttggaggtgggcaaacaaaacagagaaaaatctagacctctctctctctgtaaattgacataaagatagttttagccaaggaggaacaatttccttctaatttagcactacagagtgttctccttggaaaagccatccacttggctttgtaccctgattagtctgttctcacactggtaataacgacattctcgagactggttcatttataaagaaaagaggtttaatcgactcacagttcagcatggctgaggaggcctagaaaacttacaatgatggtggaaggagaagcaaacaggtccttcttcacgtggtggcaggaaggagaagtaccaagcaaagagggaaaagctctttataaaaccatcagatctcgtgagaattcagtcactattacgagaacaggagcatgggggtaactgcccccaagattcaattaactcccactgggtccctcccatgacccatggggattatggaaaatacaattcaagatgggatttgggtggggacacagccaaacattatcccctaaacaaagtcataccttttcttttttttttaaagaaacagattctcattctgttacccaggctggagtgcagcgacatgatctcagctcactgcaacctccacctcccaggttcaagtgattctcatgcctcagcctcctgagtagctgggattacaggcaccagccaccgcgcccagctgatttttggatttttagtagagacgaggtttcaccatgttgaactggctggtcttgaattcctgatctcaagtgaccctcctgcctcagcctcccaaagtgctaggattacaagtgtcagccaccacacctggtcaagtcatacctttttaaaatatattctcctttattatattcaagtaagatatgttctttaaagaaaatttagaaaaaaaagaagaaaaaacaaatatcttctttctttgccaaagcaaaaactgctaacatttttaaaattttctttcgaatttcatctctttaactctcttgtgtgtagtagaaaaaaaagttgtaattatattgttttttaaatttgtgctaagttttaatgcaaacttttcataaaacatttagtggaagcatattccttaatttataacatattatgatttttcttattgttttcttcattgcagattataattaagatgatcaacttttcagataacactttcctaggagaagtgttgagtcaaagaataaatatgtatgtttttattttaaagtatatatgtatacacgaacacacacaaatatatatgtatatattttttatttgtttaatttgtattgttaaagggcttttccaaaagattgaaacaaattatactccatctaaaaaaaatgcttacttaacctcactcaggtatatacataatccacagcttactcagatgtatatataattttctaatgagttaggaaaatgattacatgcctaagattttctctgtatttgtaactaaagtatggtgatttgtgaaaagcttctttacatctattttctattaagatgttgttaaatttttttgcctatctttgaggtttcttttcaatggcttattgtgtgtaaaataaaccatgataaaactattaggtaatctttaaaaaacaatttctaagagtgctgtacatattaaaaatatgaactttatattggccacatttattgcaaatattttcccagatataattagttttaattttatttatgacatgttttaccaaaaagtacaagttttatataactaattgtgatgtatttcttatatcaagatgttaaccaatattttttattcaattcttatttttcacttctgataaatttccatggtatttgtctcaaagctccacataattctcatcattccttaaaaaaaaatattgactttttaaagaaacttcttttacttattgaattttattactcattccaaaaatggttaattttcttctctctcttttcttctctctctctaaacatataatctaaacaacaccttttaagttgtttttcttctccagtaattatcttccttatttccactcttatcacagaagccaaacttccagaactatataaaataataataataatgggaatctgaactattagttgttaatataatattgatatttttcagcatgttaagaaaatacctttttatttctaaatttctcaaaagtattttgttggtggtgctggtggagaactatttttacatttaaagccagaaatgattagttatataaaactctgactttaaatgtaaaaaagtgcattacattatgaattttattacagccaggcatggtggctcacacctgtaatcccagtgctctgggaggccaaggcgggtggatcacaaggtcaggagttcgagaccagcctggccaacatggtgaaactctgtctctactaaaaatacaaaaaattagccgggcgtggtggcaggcgcctgtaattccagctactcaggaggctgaggcaggagaatctcttgaactcgagaggtggaggttgcagtgagctgagactgtgccactgcactccagcctgggcaacactgtctcaaaaaaaggaagactgtttcaaaaaaaaaaaaaaaagaaattttattacattacggaatcttttttaaggcatttgcaatatattcagtggctagctttgcaaaaagttcttatgaatttgttttatagataagatgttcaatattgtcagcattttttgattaaatatcttttttatcttttattgataaaacaatattttttattatatattattaaagtaagttattctgtataacagactaggcaacagtgaaagttttctaaatgctttcttgattcaccttaatattgaattttgctatctataataaaaaattctataattattacctttttgttatctttgtcaggctttttataaggtaataattatagaatttttggggaaaataaatcaattggtagctttccatacttttgcatgtcttacaacaaattctatagcataggaataattcttttaaaaaccctaaatactttgggaccaaattcttatttagaggtaactaacattttgatactactcatgactaatggtacattaagaatgtttttattttctggctcaatttaggtagtgtatattttctcagaaaaatggcttctgagaccttcaaacatactaagatttaattttacataatatttccttattttaaaaagttattcttaatatatttccattttaatttataacatttataactttatatatatttactcttactatttgattcactatgggtcagtcttgttttgtttgaaataaccagagttgattaagttatcaactcttctgatacctttcttctaataaataaattcttgcttttatctccatcattgtctttcctccattttcttctacttttttaattgaagaggatattatagaagaaattgttatttcttcacaattcttccttagctctcactcttgccatggttcactgtgggcagagtaaattccttggctccactgacctaggcctgaccatgagagttgctttaataacatttaggtagaaaagaagttgtgtcacatccaaataggggctttatggagcattccatgtgtccctctccacgtgtcttgtgttcttacccttgccttgggaacatgcttcccatttggcggctgatccttcagtcagcatcccagaaatagaaaaatgcataaagcagacatcagtccaacctgcagagtgcagttgagccacagcgcccaacaacgacccagcctctcttattcaacgtgctgggaaacaaacatttattacagccattgagattctgtactgtcatggaggaagacctagtgaaaagtgacgaatactttttttttttttagactgagtctcgccctgtcgcccaggctggagtgcagtggtgccatcttgactcactgcaacttccgcctcccgggttcaagcaattctcctgcctcagcctcccgagtagctgggactacaggcgcacgccgccacacccggctaattttttttttttttaattttagtggagactgggtttcaccatgttgcccaggctggtctcgaactcctgagctgaggcaatctgcctgcctcggcctcccaatgtgctgagattacaggagtgatctgccgcacccaggcaactaatacaattttacattattctttctatcattataaattgaaccccttctttatgctccatcttacctgtttattaataataaggctaaaattatgccactgtgtacagctttgtaaatgggccaaaaatttaataattttatgttaaaacattctaaaagtatgaaattatagttattatttcctatttgacctaatatatatttacaatatatattttaaaatttctatctgtgtgcttttatcatttaatccgtattattcgtttacagcattcttgcagtgttttcagagagatgtggtcttacaatttttgagttttcaaatagatttaggttgcttatatggcttacaatgtgatattttaaaatcacattactgttttggtaaatagttgaaaaacatttgatttttaataacactttaaatgttttaaacttaatctgaatatttgaatttaatttgggatataaatctatgtgccttgattatgatgactggtaagattcactttatctctgcactgtgtgctttaattttcttcagtgatacaaaaccaaaacattcatatcctcctaaatttttaagcgcattcttaaaccatttcctctgattaacaaatttatgaaaaatacaaaaacattggcctgtgcatgtttcatcccccaacacacactagtgtaaaataattttttatttctagttcacttaaattttcagtatttgacaagatattttgaggatacagttgttgattatgactgtttaatggccaaacttttcatatatttattctctgggaatttttttaacatttgcaaaatattccgtggccagtgttgcaaaagtttttaaaaatctttatgttgaactggaatcatgcccacaccactgtatatatgttatttaattctctagttcttagttgccgcattctcatttttcattttattggagcatattttcaagtaggattattcaaaaatgattcatcaatgatatatgttttgaatcctttacaatttcaagaatgtcttcacatagaaatgacaacatggctacatttataaatattgaaatgcaatttttttccctgtgagactccatataagtgacttcttctagcatttattatggtgcaaactttgaatctaacttaaaagttgtacttttttttttttttgagatggagtctcgctctgtcaccaggctcgagtgcactggtgtgatcatggctcaccgcaacctctgactgcctggttcaagtgattctcctgcctcaactcctgagtagctgggattacaggcatgtgccaccacacctagctaatttttgtatttttagtagacatggggtttcaccatgttggccaggatagtctcgatctcgtgaccttgtgatctgcccgccttggcctcccaaagtgctgggattacaggcatgagccatcgcgcccggccaaaatttgtgcttttaagtaacatccttctcttccctgcactgaaggatatgactttgttattgacattttaaaaatctaacagtatattctaggcataggtctttttcaccagctttccatgaaacatagtgatccttttaaacttacaaagccaaaatcttattagttctataatagctgttttattatgactttgattattctttttggtcagtttgttttggcttaattcccaaggattgtcagctatctacaaattgcatctttgttttctttccttgatatctattatgtttttgattgatctgcattcttaatgtacttttcaaagttgttctttaagtcactgactgcatttcatagttagctgattctgtttttaccacctccaatgaatacttttatcagtttgatgtattctttctaattttccttctcatcccatattttttatgctcacaagctgcatctctgcaaatgacaactttgtatcatctttaatctcttctgtagtgaatttgtcttttctggttctttattgaaaaagcaaatatacattctagaaaaaatatgtttctaaaataattacttctgtttgcaatgttaggacatcaaatttttcttatgttagctctttctgtagaaagagtttggtcttcatcgatttgaacaaggggatctttacccatatacacgtttcatgtaaataagtgtatgtattcattttaatctccatcactatttccctgtgtacatccagatattccttttctgatcttgtcaatgaaacccagattaagtgagattgtatcatctcctgtttccctaatccttgcagtaaagtaggtgtatttatttctggataattttaagcagcctgaaattattttcttctatttcccgcactactggtattttacagttctacttataatttgctttataaatgtgttgtgtggttttcccaacccttttcacctctaaacatgctgtatggaagttgcaatctccagaatagaggaagaaagatagtgatgtgtgagggggatgtggaggaggatacaaaataaatttcagtcatctcagtcacccatagacctgggattatcactaaattctctagatatatacagagattataaatctctgaacaaaagatccagagtggggatgaatgaaagacatctcccacccattctaatcacttctggatccattccatctctactgtatttagagcaatggttctcaaactttagtgtccatcagaatcacctggaggacttgtaaaaacaaaacaaaacagattgctgtcacactcccagaccgtctaatttaataggactgtggtggatcctgataatttgcatttccaacaagtcccaggtgatgctgatgctgctgctctgggcaccaaatttcagaatccctaacttacagcaattcttccaagggagctcaatcacagattgaaatattttttaactttatatcagtgtgtattttcacagctatcccacgagcatgtaaggaaaggtgaattaagcatccacagctagtgatttagttaaaatatgttatgtttatatatatttatttacattatttatgcattttactattagatttctttttaagattatcttatatatagatagctatttaaaagctagttggaaatgaaatgtgtttcattgtctaatagaaccattaaaggtacattgttaagactaatttgtaacgtactggccattatatctggaataaacttgtttttagtgggggattaaataaaaatttcctaatacaaaaattgagctaagtctgattggggaaagtacagttgtgtgtttgtgtgtgtgtgtgtagacacaaacatatacataaaatatatacatatgtgtatacatatatatctgagagacttgctaaagtttatacaaagaaaaattctaatttctggctgtgtgtattaaaacatgaagaacaaagccctcctgagacaacattaagcacgtgcaagataacgtgggaatggagtaggaaaggtgtttgttcctggctggccagattcagatcatttggggaatcatgtcttgagtgcagaattgtgggtcactgtgtttctctttctctttgttgctttgagttattaaacaagagcgggggactttattaaaaagaaaatggtattaatgttttagtcctgttaatatcttgaaagttgtttccctaagagtgaccagacatggtgagactttactcaatcagcaagaataccaccatgtactttaataatgaaagaaattaggctggggctattgtaagaacagtttctgaatgacgatgcaaaatataataaacacagaagtcccacactggcacagcatctgtgaggctctggggtttatgctccctaggtttagaagattttatgtttcaactccacagacagacattttcagactacctttatgtgattacactgtaatattcaattttgtcaaattatttttctttcatgcattgaattagtccctttttcctaattctctttggaattaacaaatttagattttccagcacatggcagttccatttaagtggaataaaataagctctgttcatttctcttttgctttctacagtttgcttttctctgtgtgaaaatgctgtttctttttcaaatgtattattattctcacagacacaaacagaagctccttttgcaattgacttgcctctctttctgccattacaaaattatcactatggtagtttcatgagttagaagataagtatgattaaattccacttgaccttgtttaacccttcattcatagaacacttcctagagcaagggattttgaagctgaaatatctctttgaagctgatacataatatggagaggaaaagcaatcttgccttgaactttgaaaagcttacaatctagactgtgccactgttctaaaagcgtggtccatgaacatcataggtatcacttgtggatttgttggaaatgcagattcatggaatcacctagtgaaacagaatttttgtttaaacaaccattccaaatacactattttataaaatcctttaggtgattcttatgcatattaggtttggaggctactgctataatcaaagataaattatgattagattttttaaatgatatcttagtagatttcagaagtgaaagcaatgccttctggtgcagataaaggaagtcttctggcacttgaactgaaagtaaagaaggctttttctgggttatgatagtggatcaatggctaggtggaagggaagagatgatacaagcaaattcccaaggccaggaaaacacagatgtatcattgcatagggggcaggtaagtcaaaatacaaagtctaaagacattaccaaagtactttgtgagtaccatggaagaaaacgtctgataccagcaagagtgaggggaggcctcacagagcaatttatataaggctgggccgagatgggtaatttcaatttacaagtcatctaaactgacggctgggaaaacacaaattcagattttcagagcggaagagaccttcaggataaactaatacaattcactacacaatgcatggattcctcctctacaacaggttggatgagtgtttggcctttgctgggttctactgcacattcactagcattgcgggaagtcagggaccccgaatggagggactggctgaagccatggcagaagaacataaattgtgaagatttcatggacatttattagttccccaaattaacacttttataatttcttacacctgtccttactgcaatctctgaacataaattgtgaagatttcatgggcacttatcacttccccaatcaatacccttgtgatttcctatgcctgtctttactttagtctcttaatcccgtcatcttcataagctgaggaggatgtatgtcgcctcaggaccctgtgatgattgtgttaactgcacaaattgtttgtagagcatgtgtgtttgaacaatatgaaatctgggcaccttgaaaaaagaacaggataacagcaatgttcagggaacaagagagagaacctcaaactctgactgccggtgagccaggcggaacagaggcatatttctcctctttcaaaagcaaatgggagaaatatcgctgaattctttttctcagcaaggaacgtccctgagaaagacaatgtgtccctgaggggaagcctctgaaatggccgctttggggatggctgtcttttatggtcgtagctgtgggatgaaataagccctggtctcccatagcgctcccaggcttattaggatcaggaaattcccgcctaataaattttggtcagaccagttgtctgctctcaaaccctgtctcctgataagatgttatcaatgacaatgcatgcccgaaacttcattatcaattttaatttcgcccaggtcctgtggtcctgtgatcttgccctgcctccatttgccttgtgatatcttattaccttgtgaagcatgtgatctctgtgacccataccctattcatacactccctccccttttgaaaatcactaataaaaacttgctggttttacggctcagggggcatcacagaacctgccgacaggatgtctcccccggacacccagctttaaaatttatctcttttgtactctgtccctttatttctcagaccggctgacacttagggaatacagaaaagaacttatgtgaaatatcgggggtgaatttcacccaatacaccaggattctctcatacattaggaagatatctaattatcaagacaaagcgtcctcttctggtgttctcaatttctgtttatttgtttgacatttttacctgctcatgagtcagtatctctggtgatggaatattttaatatgtaaacatcttaccttttaactatactgctcagatagtaggtttatattttacatcatttcctctgcccctggttttctaccgtttatacatgattttttttgaataacaacctgaaagaccaaagctctaacttattttcattgatatggagtaaagtggtatacatttaaattatgtattggacataagatccaagattttccaacacacaaaccgagaatgcatttaccttcttggtatgatcacaggagcaccaacatgactggctgaccccaaacacctccccactggctgattataatagacatgtaagatacatgtattttacagggataaacttgtaatattctttcagacatctaaaaggtgaacaggcatcattgtatccatgtagatacagaatagtacctaatctctaaagaggaaaaacccttagaattagaggaaaagatcgtacaaatttaccctctgcaaataaaattaataaagtcatcagcatatgactttttacctagatatagacatttacttatatgtaaattaacccttaatatgagatattgcaaatattttctgaaaatatgagactttatctgggtttatctgagatactctaaacccattttggggagatactagagtatattcttgaacagacctgacttgcctatttctgctttaaggaaaactataatccacctaattggattgtaacatgtctggtgtgaggtacttctagttattcataaaggggaaaactgtataggaagaatgcattcagaaagagtagaaatgagatccatagaaagaaggaggaggaggtcgggtgtggtggctcatgactgtaatcccagcactttggaaggccaaggcgggtggatcactaggtcaagagatggagaccatcctggtcaacatggtgaaatcccgtctctgccaaaaatacaaaaattagctgggcacagtggcgtgtgcctgtggtcccagctacttgggaggctgaggcaggagaatcacttgaaccagggaatcagaggttgcagtgagctgagatagtgccactgcactccagcctggtgacacagtgagattccatctcaaaaaaaaaaaaaaaaaaaaaaaaaggaaagaaggaggaagaggaggaaaagcagaaagagggaagaatgaatgtaaactgcaggtggcagggctttagtctgcaagaaactgactactatgacagagcaaatgcacgctctcagacctatgagcttctaaaatgatccgaatccatgctgaaaaaggaaactttggatcactttttaggttttacaaataatcttcatgcaccaagaactgatatgatcaatttgttaaggtttgcttgtctatttagctcttcttagtatagtttttattcctttgaattggccaaaaatactgtttcttcaaataattaaggactctatgtcttttgcacatgacattctaatttggatcaaagaattaagttttgtttttgttttagtgttagaagcaccttatagatcatcaacttccatatttttaatgaaaaggttaacattttgtcaagatcactcaactagttaatgagagcattggggttaggacattggggttgtcctgtcttgtgattcaggacaactctatttccagtgctccatatcacctatttctagacagtatctaatgatcactggcttcttagaggttagtagagaaaagttgtttgccttgcatttatattttaaatatttgactttatttcaggataatgttattatataattggctaatttgcttagtttaaaatctcaaatactgttttataaggattattgtctaatccatacccctaaaataaaatgcttaccaaatggcatagagaaaaataatcagtgtaattaagcctcttttgtgtatgaataaatgaaactcctgaatctgaggtataatcactatatctttaggagttctagggtttttatgttgaggaataaattgtaataaaatatttcagaagtcagcacccaaaaatgattgtttaatgacctttgaaatatcttacttgatttcaaggtgctaaattgttttaactacactaacacaaaagctctttaaaagctaagagtcacaattcaagaccgtgggttcattattttatatggattggcacaaactcagtcacctgttcacagccagctccacccccagcgcttctcagctctcatccaccatgctgtcatcacattcttagttttcagtcaaacaaggtctggagctctctttacactgcatcatgttaacatcttatttgttagcttcaagtgtaatgcctgttcaagtttggcatatgcagaagtaaccacataggttctaaatattttaaaacttgatgtaaaaagtccagattacctcatatttagttattctgtgattggccaaggtcaaacagtaaacttggtaaaaatcacaccaaagaacaagcttatctgctggtattaactctaccatttaaaaatacattgtcaaggtgtgcagaatatctaaaggactaaagtttctgctcaccatcccttaaaagccaggcctgctgacaaaggatgtgctccataagtgtctgcatttattaaatcatttaattaattgtagaatggctactatatgtcccatacatggaggatctaatggtatataatgcagacagccttttttttttttttttttttgagacagagtctcactgtgtcgcccaggctggagtgcagtggtgtgatctcggctcactgcaagctccacctcctgggtttacaccattctcctgcctcagcctcctgagtagctgggactacaggcgcacatcaccacacctcgctatttttttttttttttttgtatttttagtagagatggagtttcactgtgttagccaggatggtctcgatctcctgacctcgtgatccgcctgccttggcctcccaaagtgctgggattacaggcgtgagccacagcgcccggcccacagacagccattattttaagtgctgataacatagctgggaagaaaagacacacaatattatccatgataaggcattagataataagtcatattaatggtatttacaattgagatatctggtagtcagttaaccttccaccaactaactatatgccatcggcatgttccttaattttcttgtttgccaaatgaaaaagaaatgcaaactagaaggtctgttaagcttttccatctctctggctgtcttcggtccaatcagacgtaacaaagttggttttgccattgggagcaaatgctaacaaataatactagataatattaggaaaacaaatttcaaggtaaaaattattagtgaagacaaagacaaatattttatgaaaggtataatagaaaacaaaagattatggactttgaatccatttagacctagtttagacctaggtacaaattctagctctactatcttctaacagtgtgatgtcaaaaagctgattcaccattcttaacattctataaaatttggcaaataatatctaactgagataaagcctgtaacatagtctggcatgcaaaagcatttacacaggatagctattaatattactacaagtattatttgcatagcattttttttccttttctaagtcctcacacattagctatgtcattttatcttcacaactactctgtaaagtggtattgtccccattctgcatttgaggaaatggaatcacaaagaggttcactcactacaataggtaactataagtggataccttctatgtctctctacacaaaaattgtggtagagagagagagagatgaaggtgagagtcccttgactccccataagtatcaaattttgcacaactatttttctcccaataagagtcaatcctaaaatgtctgcactcacaactttaaaaatattccttttctatgttgccaaaaatggatgcagtgtgtgtgtgtgtgtgtgtgtgtgcgtgcacacacatgtgcacaaaggaatgcagtgtcatggaactgcgattagtaattagtagggattattcatggcatactttatagatttttagtcagtaatgtcaagatgttttccaagagaaaaaaaaaagtcttttcatcaatataatggagattaaaagcataacagaaataaaatgctggtgaaatgtattttatacaaaggcataatagccaaagtcaagtgacagagccaggaatagaacctaattcaaatgttttgactttatttcacttaaatgttgcttacaagcttagaaagtatatattgtctcgggccttaatgctttttaattttttactgtgtgttcatatcttggatagaaaaggcactcagtctgttaacaaggtcaaaataactccttcctactcttaggaaaataataaataaatttgaaattcttcaagactaaatggttaatagcagccacacttgtgagtaggaagtctgcctttaaataatgatcacaaccatggaaatcttgagacctgtctagctccggtaaaactgcctgcaggtcacactctcactgcatcactacaatcctgttttaatgcagcaggtagctttatagctgtgaattttctgaacataaattgaattatggaaaactgacctatgcacgtcacttagctaccttccagtcataactcagatctaatctttcttagctccccgcagaaaatgtctaagactgaccacaaattccagaaattacatgtgggttggtcatgggaatgtggttttcatatactgggggatttagaaaacaggactccaaaagcagagtcacctgggcctgtgatgaataactactctggtgtgggctgttctgctccagttcttaggaaggaaggtatcctagaaacaagcaaagaaatagataaatcctgggtgatccctatgcttttcctcatttatcttcctcttgctttctaaaaaaggtttataacaatcataaaaataatacaattacgtccacagtgaggggatttttttctccactggcaccaactcataggtcaaatgggagattcatactgacaagagtccagacttctctacacagcagaattgacagtgacagtccatttcttaaagaaagctggtgtctgtgcttcctgctgtcagtccttaccacagagctcatcgactctggcatcaaaggtatcagcaccatctcatgccaaacctatacgagggaatctaactgcaaaggggctttggaaattgaaaaagtttgattacaaaaaacgttcgaatctggagattaataaccttcaaagttctgaaaacaaaaatgtgagatccatttgtgtgtctctgtgttgaaaaagcaattccgcagacattttcactgacttcaaggttaccttttttaaaaattatactactgctttcatgtttctgttctgctccttgccaatgtagttaaaaattgttccatttttgaaatcagataaatctgctaatttgagtgtgactgtcctcttgtggctgctttcctaggtatattttatagctgacagatgtactgcagctcctatataattaatatcctggagtttctatgtttaaacaaaaatgcttaaatcatattatttaactgttgatcagagataaattaaaattttcatgaataaaagacatttttaaatgggacattgtctcagcatttcttttatcccaccagatgttcattttacctgagatttgttaaatgaataaaccaattaacaattaataaaataattaattaattcagtttatttttagagcaattttaggtgctcaaaaattaagcagaaagtacagagagttcccatacacccctgtcctcacacacagacaatatacccctctgtctatatcctgcaccacagcggtgcatttgttacaatcgatgaacactgacacttcattatcacccaaagtccatagtttacataaagattttctcctaggttgggcacggtggctcacacctgtaatcccagcactttgggaggccaaggcgggcggatcacctgagatcaggagttcaagactacctggccaacatagtgaaaccccatctcttccaaaaaaaaaaaaatacaaaattagccagccatgttggcaggtagtcaccatgtagtcccagctgtcacctgtagtcccagctacttgggaggctgagacaggagaatcacttgaacccgggaggcagaggttgcagtgagccaagattgtgccgctgcactccagcctgggcaacacagggaaactccaactcaaaaaaaaaaaaaaaaaaaaaaaaaagaaaaggaaagaaagaaagaaagatattctcctggtgttgtacattgcatgcggattgacaataataacatgtatccaccgttgcagtatcctacaaaacagtttcactgccctaaaaatcttctgtgctctacctcctcacctctccctcttcactatcccctggcaaccactaatcttttactgtccacatagctttgtcttttccaaatgtcatattgtggaatcagataggatgtatcctttcagattggcttttttcacttagtaactatgcatttcagtttcttccatgtcttttcatggcttggtagctcatttttttgtgttgagtaatattcccattgtctggatataccccggtttatttattcattcacctactgaaggacatcttgattgctttcatgttttggcaattatgaataaagcttctatgaacatccatgtggaggttctagtgtggacataagttttcaaatcccttgggtaaatatcaaggagtgtgattgctgggtcttatggtaacagtatgtttagttttgtaagaaactgccaaactgtcttccaaagtggctgtaccaccagcaattgcattcccaccagcaatgaatgacaatgcttcttgctcggcatcctcaccaacacttggtattgccagtatcttggattttggccattttattagatgtgtaatagtatcttgttgttttagttggcaattccccaatgatatatgatgttgaacatcttttcatatgcttattggacatacgtatatcttctttggttagagatttgtttaggccttcagttcatttttcagtttggttgttttcttattgttgagttttaagagtactttgtacattttggatgataatagtcttttatggaatctatgtatttcaaatatattattcatgtgtgtggctttgttttcttattctcttcatattatcttttgcagaacagattgtttttattttaatgaaatccagcatatcaattgtttccttcattgatcatgactttgatgttgtatctaaaaagttgttgccattctcaaaatcatctagattttctcctatgttatcttctaaaagtgttatggttttgcagtttacatttaagtctatgacccattttgagttaatttttgagcagggtgctggggatgtgtaaagattcatttttccacatttggatgtccagttgtttcagcatcatttctgaaaaactatcttttctccattgtaatgcttttgctcctttgtcaaatgttggttgactgtctttatgtgggtctatttctatgctctctattctatactatttatctatttaccttttttgttcaaataccatactggttcaatcattacagctttacaataaggcctgaaggcaggtaatgtcagtcctccaatgttgtacttctctttcaatattgagttggctattctgtgtcttttacctgtttatataaactttagaagtaatttgtcaatgtccacaaaataacttgctaggatttgtattgagattgcattgaatctataaagttgtgaagaagtgacatgtttgacaatactgagttttcctgtccacaaatatggagtatctccatttatttagacttttaaaatatctttcatcagaggtttgtagttttcctcaatttaaatttatacctaagtatttcatttttgagggtgttaaggtgtaaatgataatatgtttttaatttaaaattccaggctgggcgtggtggctcatgtctataatcccagcactttgggaggccaaggcgggcggatcacaaggtcaggagttcaagaccagcctggccaatatggtgaaaccccgtctctgctaaaaatacaaaaattagccaggcatggtggtgcatgcctgtaatcccacctactcagaaggctgaggcagaagaatcgcttgaacccgggaggcagaggttgcagtgagcctagattgtgccactgcactgcaacctgggtgacagagtgagactatcttgaaaaaaaaaatttccacttgtccacttgtttgttgctagtatataggaaagcaattgacttttgtatattaatcatatattctgcaacctttctacaatcatttattagttccagaaagagttttttagtcaatgctttggatttttgacatagacaatcatgtcatctacaaacgaagacagttttatttctttttcccaacctaggactttttaggtttatatttattgtaatattatttgtactacctcattggattgtcccaataaatgaataggtgtgctgtccatagacattgtcttcatcttcctaatgagagaatgatgggctaagttgctcagattcacatggtattgaaatcagtatttgtttcactctatgctctttcctactacattagactatactgccttccaaggttctaacaagttttgattttaaaagcagcatcacatttcttacttaaattagtttatacatcaaatcagttaatttaatgggcaactttcctaaaatttcttttaagtgtactacacacaaaaaagaaaaacccataaactaacaaaataagttaaaaagcttacaatggatttatgtagtataaaaataggtggcaaattttttggcaattaaaaatgtttgaatgctaaaaactgcaaaacattgatttaaaaaatcaaaggaggcctgaataattggagagatataccatgtttgtggattggagaactcaatactgttaagatctcaatcctttttaaactaatataacgattcaatatgatttctatcttaatcttaacaatagttgtgtaggtactgataggcttatactaaaatttacatggaaaagctaaagaaatagagtagccaaaccaattttcttaaagaaaaagaaagaggactgacaacacctgatttcataacttactataaagttacagttttaaagacaatcttgaataaatggtagacacatagatcaatgaaacagaacacagagaccagagacatacccacacatataggccaatagatatttcacaaaggtacaaacatgatttaatagacaaatgataatcttttcagcaaataacgctgaaacaattagacatccatatgtaataaataagtaaactttgaccctttatttcacaccactaattaactaatatacaataattaatgcaaaccctaaaattatcagacttccagagaaacatagaagaaagtcttcataattctggattaggcaaaagtttcttatctaagtcataaaagcataatccatatatagtaaatttaataagtttgatttcattgaaattaaatgttctgccatggacaagatactctgaagagattagaaaaacaagccatagaaatagagaacatatttataaatcccataaataataaaaaacttgcattctaaatacataaacaacttttaaacaatacaaaataagaaaatagggcttgaaaataaaataaaagatatccacttcagaaaggaagaagtatagctatattctcagatgacatgatcttgtatatagaaaatcctaaggaagacacacacacacacgcacacacacacacactgtatgaacaagagtgactctatttaaatgctaatctgccatgtgactcctgactaaccctaagtctaggaatgcctccaagatgtctagctgatgtattactttttatatagaaatacctgttcactgtaagttttccctttcctccaaaacaacccttgatggtgttgcatacatcataggctatgaggcccatagctacctactcattccttctggagcacatatactttttccccaattcaagcctggactaagggggttgtggtgcagagatctacctatcttgcagctgtgtaagacatgcttccatttgtaagttctcccaataaatcactattttcctataatctagatttgtctgcctcactctttgctttcttcactgttagcctttggaggatgctttgtatatacagccctttcatggaacacacattcacacagcaacaattagagctaaaaagttcagcaaggttgcaagattcaaaattaatatacaaataacaggccaggcacggtgactcatacctgtaatcccagcactttgggaggctgaagtgggcaggtcacctgaggtcaggagttcaaaaccagtctggccaacatggtgaaaccctgtctctacgaaaaacacaaaattagccaggcgtggtggtgggcacccgtaatcccagctactcgggaggctgaggcaggagaatcgcttgaacctgggaggcagaagtttcagtgagccgagattgcaccattgcactctagcctcggcaaaaagaatgaaactccatctcaaaaaaaaaagaaaatatatatatatatacacacacacacaaataacaaattatatttcaatacactgcaataaaaaaatctgaaaatgaaattaagaaataattccatttacaatagcatcaaatagaataaaatttattgataataaaatttactgaataaatttaatgaaataagtgcagactgaaaactacaaaacattgttgaaaaaaattaaaggagatctaaataagtagaaagacaactcgtgttcatggatcagaagacataatattgttaagatggaaatactcccaaactgatctacagattcaatgcaatccctatcaagatttcagattgtcattgaataaattacaagtttatcctaagattcatatagaaatacaagggacctataaaagccaaacaaccttaatggaaagaagaacgatactggaggattcatactttctggttttaaatcttactacaaagataaagtaatcaagatagagtggtactggcataaaggttgacatatagatcagtggaatagaattgaatcttgaaataaaccctcacatttatagttgatttatttatagcaatgtaattgaaaaataattgtcttttcaagaaatgagctggaataaatgggaatctacatgcaaaagaatgaaattggactcttacctaacaccatgtacaaaaaataactgaaaatagatcaaacacctaagtgtgagagctaaaagtataaaactcatggaagaaaatataaaaataaatctttatgaacttggattaggcaatgacttcttataaatgaaaccaaatgcacaaatgacaaaagaaaaaaatagataagctgcatttaatcaaaatgtaaaaccttcatgcttcagagaataccatcaaaaaagggaaaagagaacccacagcatggaagaaaaattttgcgaatcatatatctgataagggggttacatcaagaattcataaaaatgggcaaaggatccaaatagatatttctattaaaaaggtatacagatgaacaataagcacatgacaagctattcaacatcattagccaacaggaaaatatagagaaaagccacttcacccccacgatgatggctataatcaaaggcaaatagtaacaactgttggcatgtagagaattgaagccttcatacactgcagatgagaatgtaaaatggtagagcctggcaccactgaaaaacagcttaatggtttctctaactgttaaacatagagttatcatatgaccgaaacccagaaatgccactcctacatatatacccaagagaaatgaaacagtatatctacacacaaacttgcatatacatgttcatcagaattattcataacacccaaaaaagcagaaatgacccagatgttcaccaacatatgaacagagaatgaaatgcagtacacaacagtatacatcagaactgggcataagccggaatgaagtactgatgcatgctacacataggtgaaccttgaaaacattatgccaagtgaaaaacaagtcataaagaccacatattgtatggttcctttatatttaatgtccagaataagaaaatgtgtagagatagaaagtagggcttgaaagtagattaatagtttgatagattaatagtagattaatagttacctagtttcagggagatagaaaaaatgttttaaaattgattgtagtgatagttgcacaactctgtggaatattggaaacaatcgaaatgagtgaattgtataaaacatgacttatatctcgataatagatatctcaaaaaagatcattgatatcatttgtaattagggaaatgcaagttgaagcattatgagataatattacatacatattaaaaatggaaaacagaacacacacaaaaattatcaatacgaaatattggcaagggtgtggagcaactggaattcttatacattgttagtgggaatgcatgtgccatatgactcagtaaatccgcttctgggtgtctacaagagaaacaaatatttatttacagatagaaatctatactcattcctcagtctaaacgttgccagtccttctgtctctaaactttccctctattctcatctccttttcctaattcaacttttaacccccaaattctctttagttcatagtttagaagcccacttctcaaaattggaatgtttaatcctaaactaattcaatctgcatataagttcccataagacccagtaattacaaccatacacaattgccatttacttttatttagctcctcctaaatgctaggattcaaagaggtagagtatatttcttctgattgtgattgaatctctagcaccagcagtgcttctgttttatttttaaatttatttgaagaacatttgcccttttgcaagcataatgcaaactttaaacatcatattgctagctaagaaaaatttaaagcaacatagataattctcctttgacacaatgatctgactagaccaatagctggaataaaataatgagaggaagacattagagtgaaaaaagaggaggacaggaagagagatcatttgcagtacacagtcactaggctgattcaaagcaccaaagtgaaactctctaaggatgtttcacttttatattggaacgccatatataatttcataaaaatgtcaaagtgattttgaaaactcaaatctcttcaagttgcttatacttaagacaaagcgatcaacgcaattcagagtaaatttgactttgttttttagtgatgggagcatttcttaaaaagcatcaaatctaacatttctatcttgcagaaatcaccaagcctagttaattttctcatgaaagggactttctgggtatacacagctacagatttaactaggtctaacatacacatgaataatcctttgcaaggtcccccttcctctctcctgacccctaccctaacattgcttgcaagcagcagaggagataaggggaaacagctgatctcctctgtgtttctctaatccacttcaattcacctcctaattcaagataaatcactacaggaaagaaagctgggaggaacccacttccctaaatcaagttcccttcctgtattttactagatagttgcaatacctgattctcaccaaaataacgtcctctagatcttatagacatctttaacaaaaatccaccttgttgagccttgtcttttcaaaacttgaccctagagcagaaattgcaaaactagtgattcttggcattatgtattgtcataagtgatgggattgtgtttttgctttaattttgctttaaattgattcagctctctacatttcaaaacaaacaggcttttacattgaaatccatatttcttagttcttttgagaaatgtgaatgtctgtcaacactaggcctgcattcatgcacagcaataattgactggggacgagtagaggccaacccctttagactgagtgtatactcattatttcagcacagcctcatgctcctgagccctttctttcactcattacttcttggtaacctactgtaagcatttgaattttctgtctccaccttagggctgagagggggctgagtgatagggagtggcaactctaaatgcattttagattaggaagaatattcataacaaaatgcccttcgagtctatacttctattaggaactcaatagcctattgaggattaagtaaggaagctaactagtatacatagcactggttaaaagacaaaatggttccaatcaacttacaaatggactacttgtactttctcattagaagaagatgactgattttcttaggtcttgtgtcctgggctaatcgctaagcaatagctaagcagttacttaagagttagaaagaatgactgcatgcagattttacaggcagaagtgtgggcttcccagctctctgcttctctaattaaggaaggtggaataagaagaaatctaatcaactcagaatttttgcagcctgatgtactcaatagcaggtctcttgtccaaaagcgttcagaaaggtttctcctctcttcatttaaataattaaacatataaaacttgggctcactttctacttttaaatttattatgctacctttatccctttaatctctggcattgatagaactgagctgatatctacttttccatatattagctgtgtgatcttaagtgagttgcttaatttctctcagctagggtttccttatcagcaaaatggtaataatagtatttatctccatcattgtgagcattgatataatgaggtaatgagtgtaaagtattttgcatgattttggcacagattactaaatattttattttcctttattttcttcccttttcttttctttttattatttttaaagttattttcatcctataaaagccataaaataaccactcctgcagtatgtctggttaactagcctcttccattcaccatcaaattacctacatgtatgaaacaaataaaagaactctcccctttggtttttagaactttcaatgccaggaatggagaaaattattttaatctcacatcttccatttatagataatgaaactgaattccaaaatttagtgatttgttaaaagcacttcagcatgggagtagaactcattcattttaaaacacaaaagacaaaaatggaatgaggctttaaccagcagggttcagtatatataagccctaaagagcacgtcgtagggactcattatgcttgtgtttaattgagtggaatagtgaattgattaaaaagaacagatcatccccaaagtgcatgatcaggctgatgattaaaacaaagtttggtttcaagactgggattattcttcagctagttgtcagttagcatgtttgcttgttacctcttgaccaaataccatgttggaggtcaatctggggaagttttcaagttcagagaagtttcacccaccaattaattgtatatcaaaactttgggccgggcatggtggctcacgcctgtaatctcagcactttgggaagttgaggcaggcagatcacctgaagtcaggagtttgagaccagcctggccaacatagtgaaacctcatctctactaaaaatacaaaaattagccatgcgtggtggcaggcacctgtaatcccagctacttgggagactgaggcaggagaatctcttgaatccaggaggcagaggttgccgtgagcctagatcacgtcactgcactccagcctgggtgacagagggtgagacttgtctcaaacaaacaaacaaacaaacgacaacaaaagaactttgggtacataattttagcagagaattttgcacatgacaacttttgacctgttaatgttgctgaaaaacaattctatctgaaattgaaagttggatacaagggtccaacaacatatacatttgaaaattaccttatgaagtgaaattttcaaaaggaaaatgtcaccgcttgtcagagctatctgaagattcaggtgatctcttttcaggcaagatttttgaaaaaaacatttagagaagaaagggaagacaaatgtttcctgaacgatgatgtccacactgtgtggcatttggtactttaatgtgttcgtattcattggatcctacttgcttcaggttgcagtggaacacttcttttacaaggcagatataagagatatcaagtgtttttcctaagaacacctagccaggattcaaacccaagtctgtctccatatttcatactttactcaataaatcacgttgttgtccacatttcaagattttctatggggttaatagatgttcgtttattcaataattcattcaacatttattgaacactgcacttactaaatgtcagactaagaaacaaaaacaaaggttctagacagtatgtccagggtccagcacagtatatggtcacaataggctttaaagacatatgtattaaattaatgaataaagacacttctgctctcaacttgctcattatctacctagaactgcactgtctgatatctggccaccagccatgtggctattgagcacttaaaatgtggccagggtagattaagatgggcttcaaatataaaatacatcccaaattttaagtcttagcataaaaagaaatataaaatatctcattaatggcttttatattgattatattgaaattatagtgtttggggtatattgaattaaatgaaacatattaaaaccagtttacctgtttagttttttactctttttagtgtggatcctagaaaatttaaaactatacatgtaatttctttcaattcctattggccagccttaacctagtgctgttaagtcctggggcacttgcttttctgtttcaagttcattattaaaactagttctattctctctcttttatgtatgataataagttaggtttaaatgcagtttattttaaatgcaatctatgtttgtgagattagaatcaattgttaaaggttagaaatttttgtattcagatgcaaaatagtccacacgcaggctctactgaaatatgacttccctttagtccctttcctggtgagaagctaccacagttctccagatatgttactgccagctatacaagaggaagtctaacccgtgcagcctgataatcaaatatttaaggctgttcaactgcctctatcccatctcatgctcctgccaacttacctatctagatttcctttctacagtattcctggaacacaggaatgagcactgtacctttattcatgctgttatctctacttggagttttttgtttgtttgtttgtttttcaattccaatgcctgcctagttttcaaggttcagcttattgtttacttcttgccaaattcccaaactactataatcccatataattttctcttttctccgaattctaagacactaacattccatttgaaaatatctatacttgattgtgggaaggctcttacttttctataaatgaatcattacccttttcttatattccaaagaccgtaagtagaaaatttataaagaaatcactacaacatggaaaggaactcaccgtgcatttggttaggcttttaaaggtcatgttcagccacatctttttaacagtaaaaggactaagatgctgagcagtttataaccaagggagtgggcagtcacaccggtgtgctctgttctacataagtaaagcattcccgcctatagcatcccttccctaccaaaacaggagagctgccaagatgctcacttagaacagttgttggtttgtgtacaagtgttaagtatgggtttgttctttttcttttatatttttttgagggaaagaagaaggaagaatggaaggggactggaaaagctgtatttatttataatcaaacatatccttatttgataacagatgaccaattaaagcaatgtgtgaaacttgaacagcattctgtcaaaaagcaaagaaattagcagagctcatagcaatcagcacttcttgcaaactgcaagagtcccctctaaagccttctgtcttggcactggggctttgctaaatagggctcaccattttgcgagtgggaacaatcagctttgtaggtggtagggaagtattataattaaatgtccacccactttttcctttctgatgaaaggctcccatgaaacttactaaaataaggtacataaagatagatgaatttttgatgagtaagtcaaagcaccgacaaacctggctttccacatagagaaaattctttaatttatagaaaaatttcggcctagatcattaatactgtcatatttaataactaatacgataaaatccatagggtaactggagatttcactgttttcgttggtagtgattgtagtgctcagcatgaattgacttgcagaaaacaaatataattcaaaaaaagagtgaaatttttcaaaattgattttagagaaatattaagtgatagccatttaatcataatagcctttttaataataaataatgcatttattgaatgtaatggcattcttccgaataatagttatagtaccactttaaggttagaaactatatctctgatatagcaaagggcttgaaagatgttattgaattgtcagaaactttttatgagggagctctggaacagagtctatagagtctgcttttgataattaatggtaatggcatttactaaaatcactgtgaataattaattttaagtacttatatgcagtagagtagggagcttctctgctttataactgagctcagacatatatttcaagtccagttactagcattcacaaagtcaatattttagaaagaaaaagaaattaaaattaattggtactatgaatgttttccttcattcaatgtggatttattgggcatgagctgtatagactttgctatcagaggagcctcaaagcaataatcctctctagaactaatgaatatttttatttttaagctaaatttcatatttttatcttcctgttcaatagattttattggcagaagccagtagagataacggtgccctaaatcaccaacaaggtgagatcaaagtactggggaggatatgaacacatttgtcattaattgaacacatttgtcattcattgctaatcactatgtgaagatgacttttaaaatactcctgacgacttcttatccttccccactgtggttctgtggatccaagaacacagagtaactggatgctcaaagtaggaaaagtttgcataataggtactcagctcagcataactaagataaaattagccacaaagatctagattctccagttactggcactatccagggttttataaccatcattacccatgatcattttatagtaaactacaataatagatgtggtgacacatctgaggtctcctcctgtattattagtatagcgggacacctcagatgtgtcaccaccaaggaacaggcatgttcagaccaaattcttcggccactgtcctcctcattcccgtttgtttttttgaattccccagaacttcttgtttttcaaattattacccacatacttttttaatatttcattttctgctttgtgtttagtcctactttttactatctttttgtaaaagttacacgttaaccattatttaaagagttcctttaacagtgtggaggttttcttcaaagacttgatagaaatctttaaatatgggcttttttctcatttaagtcttacttcaacatgttcactgattttagatttctctgacaaacatggttgaggtatcaaaacaaagacatgttgataatagctttttctcaaagtcatttagaatgtaagactttctgccgtgctatgtcaaattgcccaacttgggaataagatgagtgtatgtgcatgtctgtggggtggggtggtagggagcaaggaagtaggggattggtaaatagtctatacaaggagaactcatattgtcctctaaaactgatatatttaggctctcctattttccacgagtctatcatagacacttgtgtctcaatgtttgtagtaaattactgatgattttctctgttgctttggttaggaagatcctttcaaaaacagatttttctgggagataaatgcagtactttttcttcttcatgagataaacacacacacacacacacacacacacacacacacagagagagagagggagagagagagaaagagagaaagagagagagagaaacaacctagtgtgcaagcagtatgcctaaaaatcatttttattttctcctgttataggaatctataagtctgtaagtctctcagttgaaaaaaaaattgttacatcatagaatttaagaaacttggaatgaccttagatattatcctgtctaactttcactttatagataaagcaaatgaaaccctgagaagagtagtgaccacaaatactttgctattccttctattgagaaatgtagtctcactgctcccttttcctgtgtctgggcagtctctgtaattggtttgaccaatagaatacaaatgacaactgcagcttcctaattcttgcttgcatttgggacttctcatctcagaacccaaccaccatgctgtgaaaagctgaagctacatgaagaagccatgtattgatgcaccagtcgacaaccacagctaagcccccaactgacagttaacgcacttccagtcatgtgaatatgccatttagcatgtccggactaggccaacctttggcaggctccattccctgccagtatgtgacagcaatcacacgagaaaccttaagcaaaaattgcccagctcttcccagtcaacccatagattagtgagagataacaaatagttgctttaaatttcaggatggtttgttatatactaaaagctcatcagaaatgaaagtgacttagaccaaaacttctaagcattaccagagtgaaaaccagaactcaaatatcaccccaaacctcgtataatctcattataatgtgttaaggaaacatgtcgagttaaatgagatccagtttcagtctcccaatagttcataattccaaaagattttattctttcaaaattcacatggaatgcagaatttccaaaattcttgaactttaaaacaaattcttagagctgtgtctacataacagtaaaccatcatttggtataaggtagcattcccaagtgttcctcgaaggtagtgtcttagtaatgtgccatgaaagaaagagagataagctgatttaatttgtttaaactaaattaaagaggtctctttgcttcaggatttttcaagaatgtaaattttccaagaggagctatagatagtacttattttctgagaattgttcgaccaaggcacccttcttcatcaaaaaactaaactgagaaataggaagaggaattcaattttgtcagcataaaccaagttttgctttcagaggatttcataaaaagaagttgttttcataatttggtgtgtcttcagcttagagaacacatttttagataacacttttatgactgtcagggactgtgcttagttatgtcttttacaacctgttcccatttcttcccgccttacttttaacattctttggtgtctacagttaataaatctttctggaatgtgtagacgaaggaataaataaaagcagataaataataaataattcaattaattaaaaattatcctgaaatgtttcattaacaatgtcaatgactatgaagaggcccaaaggtttttgagtcaacctctcatttagtttaataacctggaaattagctccaactctaattagcttggtttgggttttatatctttatttacatctaaggccaattgaaattgtaacacttgccatatctaacagagttcttgggaaattcaaagaagatttcaaagttggaggtggaacggctttgggctacaaaaattgtagcaatcatgtattcatccactcctttcatcttctagttctggagattgagatccagaaagagagtttatagcgcaaatgctagctgcattggaaacctcctccccgtggatccacgttaaagatgttaggaaagttctctttttcagtagatgttatattgaatggtgtgattctaattcacgtgctgattattagacagactatttacaagcatttgggccgtaaaaacatatttgaccacagaattcatgactggtataggaaggtgtggcagtcaaaacatttaataacccatatggcatggccactgacaaccagagtagacaccagccatgaacaactggtgcagccatgctgatgagtatgagccatactgaatatcatctgagatctatggatctagtagataacatttcccacttcttgccactggtttgtggccttgtgaatactttcatcttatttgtattagacattcctccattcaggctgtctcttaaatatacttgtgttattgacatccataatacagtaagttctattatctctctcctgggaagctatcagcacttcacagctccttcagcaatatgctatcctgttccaaaaatcatggtgcattcccatgtctctagtttccaagcagagggaataatagttttatggtcttcttttgcccctgtggggacatgagccagttcactacccctacttacttattcctggatatctctaccctgtatattcctatattcttgttctgtagtcatgctacatagttaaatatgacttgaaaggctgacagagtaatgcagctacaaaaagatggcagagaaataataaaataatatgtgatagagtatttgatacttttaagtcagaatgggaagaaaatatttgtaaggataaatcaaagtattctgcatttagccagttcctttgtgaagctctaataaaatatgtgtttaaaaaataagacaagccaatgtggagtgatctatacaatcggacatatacaccttcatattactttggccagactctgctgtatttgtaacacggtgtcaaaagtttttatttaggtacaattcaaccataaatggagaatgggagcctcattctcctggactttagtgagttacagttctagcatgcttacctctacaagcctgctggtgtgttcatgaaatatcgcagcatattcttttatttccttttcccggccattcttagcagcttcaatgagaaccaaaagagggactgtcgtatccaggaaagagtctgacacatgatctataatagccttgcggagctgagaagaaatgaaaaattcaggttttttttttccaggaaatagttcactgtgtttccttttcttacaatctcagtagttacacaactcatttttcatttttgcacaattcctaaaatcacaatacttaaagatatacaagaatgtcccttaagaaactaaaaaacaaaatatccaggcaaaaagaaaaaatcatctagcaatatttcctttcctctcaaaagtaatttttcttaagttgtatttaacctggaagtcagattaaaaatggtaatactttcttttttgctcaaagaaattgtgttattagaatatttatgagtgtgtacacataatattgtacatcttgtatttttataattacaaattatagaatgttttctaccttgttggaggaactgatgataaattttgattagctaaattgtagacttcatagtaattaagccaagttagatcaccgattatgccagttgataacagattaatagagcaagaagaataataaatgagtttgatgtccaattttccccatttgcattcattgttcttgccctcacactttaaattattaaacaactataacattctgctacaattagttcttttcaattagattacatgtaagcttattaatgacaattaggcaattactctagtcagcagatattttctgagatttaaaactgcactgaaaaattaattcattgtgtttatataatatcgagtctttaaagatcataatatcgggccaggcacagtggctcatgcctgtaatcccagcactttgggaggccaaggcaggcgaatcacgaggtcaggagttcgagaacagcctggccaacatggtaaaaccccgtctctactaaaaataaaaaaattagttgggcatagtggcaggcacctgtactcccagctacttgggtggctgaggcaggaaaatcacttgaacccaggaggaggaggttgcagtgagctgagatcgcaccactgcattctagcccaggcaacagagtgagactccatccactccccccgacaaaaaaaaaaaaatcataatatcctgaaatgtttcattaacaatgtcaatgactataaatgggcccaaaggtttttgagtcaagaccttcatatagttcaataacctctgtacaataaaacagataaatagctgtcagacagaaaaatgtaatttttctgtcaaagttacattttagagtatttttttaaaagaatagacacttagtttagttttagattacttgggaatgaatagtaatacattttgggagagctgaatgatagagctaaatagaaagtactgtcttctataatgatcatagaataataaatccataataattacaggtttctggaagaaaaatatctctgcccaaaatagtgagcttgctcagaagcattgtgaaattttctgactatcaacaatttaagaaaggcttcaggaagatccccaaggaaggattctgcttagtatgcagaaaggcaaattactagtggcaactaatatttactgagcacttattaggacaaagtatagagtgccaaggggttacaaggcaaaggggagaccttaactgaatgaataatgtgtttgctgtctataggaagtacaccagggaagtcaggcgtaaggtcacgaatttatttgagctgggaactacaggttgtgtaagtttcagatactgaagagaaaagtagagattccttctaatttctcagagtgggggcattttttaatgattatcctcccctttattcttttcttctttcattcataattaggacatgtagattattcttttcttctttcattctaattgagacatgtagaaggaaagctcagatgaaatctacactagagatatgccatgaagggccagcatatgggaactaactcaagcggagagtgtggatgagaccatatagagtgaggagacccacagaggacctcttaggaaacactatcatttacaggagtcatgattaaagagtagggcctaaaaagagactgagataatagccaagaaacaaagagacaaattacccacaactaaaagacaaactttcaaatatatctctgtgttaatgctcttcaaatgtagttatcctaccaaacataactataatattcccatcatggacttgttaaatcttctctgctgtgtaaatgatttcattcaattcagtaaatatttctggaaaccatttcctcacctttctaccaagagaaaggtattgaaggaaatgttaagatggaaattcatgatcccttataatctagtagaagagtgaatattacaataatacattaaacattacaataaagaaaaacttagagactgacagcaaaaaaaaaaattagagtcaaattttaaagataaattaaattaaaaaaaaggaatgagacttgtcccttgggcttgaatactaagaggttattgataaacttggtaagagcagtttcagtggaaaagtgggctgaagagtcctattgctatggtttgaagagtgaatgagagataaggcagtaaagacagtgagtataaacttctgtttttaataatttgattgtgacatgaagaagcaagacttggtatttactactctgagatatatgtttaaagagtgactgtttttcatataaagacttcactataatttcccatctgcaactatagccaaaaagtcttattactcccctttgctttgctggaaatacatattgatttattgccaaagcaagaataacaggtgaaaaagaactattgtctcacattgtgccaacttttgtcatcttttcgtcccatgacagaaggaaatgcccagaaatcagtgacttgagctggatgtgaatgaaacctttaggagctagcacatggtcagaggcagggatgtatctctcccactgaaatcatcttaacccatgcaaaaaacaaagtgtaactaattcaaccaacccacaatattctcaccagtctaaccattctccctgtctaacttgctggttcctgatcctttaccttcactattatgaactacattatagacttttggtgccttatatctcatcctctggatctatctctgatttcagcttttgctggggggaacagttccatgtcctctgaagacattccatgcttcttgtgtgccttccttgtgtctctttgttattctatctcagggcctgttccaagtctctgtgaaattctcaacccagcataaacactgcctggaagttcttcagcgtccacaccactgggggaaaccctcaacctatgcggatagaaactactgcataaaattcctaccctccatccattagtcagacaattctgggaaacattctgttattctcagagatcctcaagctctcattgcctacagcagcaatctcaatagcatatcatttcctctttccctgcctcgcttttcatgttctataacacttgcttccaggaatcacctcctaaataaatgacctgcactaaggtcctagttttagtcactgctttcaggaaaacccatctaaacaggtacctttgtctggtattaatgttgtttgatcatgcaccaagtaagagactccaatgtcttatgtaaactactcattgctaattatactctactaccttggctctgtacatcactgggttttgttctgccatgccctgaattatactcactgtaaaagaggaattattatgagacaggactagaaatgtaggtagggacaagatgtgaaaggactagaatgttatgctaagcaattttcattatatgttctgacatattcatatggaattgttttcattaaattgtatagtcatatatacctacatataacagcaaagtagcctctatcttatttatttccgcattattttcctgcccagtggcacaatgcattcctttcagttgggtgatatacaaaaagtttaaagaagaatgcaatatgccaatatagaaatggaagccaaagcactaaaatctgaagttagtgggaggccaataggaattacagatacatactttcaataaatacctgtttgtggccaggcatgaaagatgttagaacaaaaccaaactgaggtgcttttcatcttttctcactacagtttaataaaaggctttgagacatcaatttttctatttcctactgatgtaagtggtttgggatctcaaaataatatatatcactacaattgaagcccaaagtgaaagccctatgtgaaaagtctaaaaaagccccaccattcccaccaaataaaggaacagaaagaatgaaattgtgatgggaaggggaatggaaaggggagaaagtgtttcagaaaggaatcatcttcagggaaacagaaaaatacatttagactaaaatattttatgttaaaatattgtattaaattttaataaattaacagtatttaaattttaataaatattttaaattaaaagccattttaatttaaatcaaatagcaaaatgtgatttttaaagcttggaattaaatgtactaataattatttcactgtgtatgtactatgtaagtttagtgaaacttgtctcttgtggatacataatgttatttgatgatgaggatgatgaccaggaggtataaaagcctacatatttttttctgagtggtgaactggtactatgcaacatggaagagagatggacctaacaattcagaaactcagcaactaaagaattaatcaagtttttgttttgtctgtttttaccaaaatcccatttgacatacttcatctttactttgatatttatgaaataaaagacatttttcttaatatacacaaatacaaattttagcctgcctttagtgaaatcaaatatattttagtatgtatagtaaaatagaaataagatatatttgttgcttaaatttttttataaagtaaagaatgtttaaaaagtcttcctccttttactgagagagttgcaataggtatacagttttcaaatgaatgatggaaaaagaggctaaagaaagaagaaaatttaactttaaaaaggcatttaaaacaaataataaagaaaataatacatgatggtaaaatcagtgtattaggcactgggaggttctgaaagtgaataggccataatccctagcccctggtgtggtgattacacatatgggctggggttggatggacctgggctagaactgtgtctctatcacgtagctgggtgatgtttgctatgttaactcattttgggggacaaagataacaataccatggcattatttattgttttaggaataaaaattaataatgtaatgaatatgcttggtagagagctttgcaaagcatttagtaaatgagagatgttgtcatagctatcattataaggacttaaaatgcagtgggaagaaaactcattacaaaagaaaaaaatagaagaatataatcattgctgtaatatgcacatgctgtaagtgttccaggaagaaaaaggtccattccagctggtgaaaacagcaaaggtttcatggaagcaatagcatttacactactctggaatttagttgcttatgagttggggttgtgtgtaaggagagtgagtggggaaggcatcaagctgtacaagtcatatgtacaaagatgcaagtgtatttgagcgggaggtgatgcaaattctggtaaataacaagtagattctttcatcagaaaacaggttaatgtgggccaggcctggtggctcacacctgtaatcccagcactttgggaggccgaggtgggcagatcacaaggtcaggagttcgagaccagcctggccaacatggtgaaaccctgtctctactaaaaatacaaaaaagtagcagggtgtggtggcatgcatctgtaatcccagctacttaggaggctgaggcaggagaattgcctgaacctgggaggcggaggttgcaacgagccgagatcacaccactgcactccagcctgggcggtacagtgagactctgtctcaaacaaaaaaaaaaaaaagagagagagagaaaagaaaacaggttaatgtgttggtgtgatgaggaggacacaacactgcgaaggagagctgaaggaaaaggaacattaagaataatggggattaagtcagggccaaatcacagagaacctagaacaccatgccaagaacatttgtctttgttctctagtaaaacaggcaagaaagtcacagaggaagaagattgaaacaaataaatactctcgcctcctagaacattccatcttgatgtcctcaaatctataatttgcttctccttagatatttctaagcaatctctgtcattcctcttggaagaaatccaatcaccctctgaactgaagctgaaatgtttctgcattactgatagaaaggccatggttaagaaaggggataaggatgaatgggcaggaagatgggctctgcttattttttactaaaaaaagttttaaaagataaaaccagttctaaagcaaacgatgaacattaaatactccaaagaaaaacattttaagggcagtgctttctctttcctgtgagaagaactatatgtgagatgcttacaacaactgttggataaacttcttaagaacaagaagtagagataacttatattgctgttttaattaactgtgacttctaccaaaaatgtaaacatcaggatgaaaaataaagtactagggggagggtaagtgaggataatgagaaagaatcatagcaactaacttcatcaaaacggaagatcatggaggtgttcaaagacagcttctaacaattccatccattcctgtacacacataccacttctcctacaacagacagaacttctgcctactcctattgaactgggacagggtttttgactgttttttacttacagattatagaggaaatagcattctctgactttggagctaaggcactaagaatgcttgtcagcttccgtctcccttttcttggcaacttgaaacagcatgaaagagatctaggctaccctgctagagattgaagccacatggagaggccctaaaacattaggcaccgtatcgagagagggaacaggaagaagcactgaggttccaaacatcaagtcccaaatctagccacagatgccatttgactgccactatgtggaaaaccacaagtgaaaacggtacagaaaatggccccgctgacgcccagccaacccaagacatcgtgagatgcaaatatcgttgctactgtttgtggtggtttgttaaacactgatagaaaattgaaacaatggagatgttaacctgtgaaaccatacagaatgttaataccttcagagcacagcagttttctacaagatgggagtatcttcttactatgaagaatagtattagtaatccccaatgctatttctatatctcactgatggtagtgaggtggaaatacaagtaggattgcaatataaaatacaagatgctcggttacatttgaatttcagatgaacaactttttaaatataagtatgtaccatacaatatttgggacataattatactaaaccatgtttgttgttaatctgaaattcaaatttaactgggtgccttgtgcttttatttgctaaatctggtaattccacacacaagtaattgcattttcttgactttatttagaaaaataataattctaaaacctttagaagtataaatgtagattagctctttatgcataatgttgttgaaggcaatatagagggaaaagacacgaacgagagacacaatcattgagagctcatagagacaacttttctgagtcctaggtgaagcagatggggtagaaatcctgaagacgatggagaatagggatcattccacgaaaggggaggatcgctctgaggatataaatttctgagtcctggtacaggttctgactcggtgccccatcctcttaggcaggtcacctcaccacactgacctgctttctcatttgcatcgtaagacaggttgtgctaagttccttctgactcttacattccatgattacaagtgtaaatggtagaaacagaattcacattaagggcataaagttgagaaactgagattttcacagacttcaacattatgtttttatgcagctattattaactggctggagatctctattccatttccaaatctacgtccaaattaaaagattgcttagccattttactaaatcttgccattaaactacgataatacattgcattaaaagttcatagttgaaaagctttttctcccttttgatgagttaatgatgaccaagtgaaagttctgcatgagaaagaactctggttattgaacagaggaaaggaatgaagagcaaatgtctttgaaaatagctaagtcttcctatttctggaaaaatgtttaacttgtggcatcatactagacttataaattgtttaatgaaattctttctaatcccatgttcctgatgacttaaggttaaaaagaaggcttaacttttacaaaaactaatttttgaagtatcatgaaaaaaaatggaaggaggaatgggtagggtctctgaattacttactagttaatcatttggatttaagcatttggatgatgaactctgatgtaatacaatcaattgatcaacattccctaaaaacttgctatgggtcaggcacttacatgcattttattgattcctcacagccctattgcatattattaatttcattgtataggttcaaagcagctcagagagctgaaatatgtgccgaagatctcacaactgatgagaacagaaccagaatttgaatgtaattctgtctgataaggcacacattctttctctgctttgtatttgccacaaaaaacatttgaggtatgaatatataaatgtggaaagtatatatttactctttttttcctgttctaaattaatttgaaaggaacaaaacaagaaacaaatatgcctgcaatgaataacagtttcatttagcccctatgtttctgactccatatctctctcttccctcacctgtctgcgaaggtctcttgtcttcttacacatgttgtctaaagcaatattcagggtattactcctttctttttttccagcctgcaaagaagaaaaaacgacataagcaatggtatcaattaatctttatcacttagcaatttgctttctaaatttcctgaaaataacagcttgaaattcaagaataggtttcaaaactgctatattatatatgattcatgagcatttcacttaagactaagtagaatggtgattaaagctcacattattttcatctttatgcttctgtaatatttccgatacggagttaggttgtattcagtgtgacaataggcagagcattatcttcatgaaactctgatcttcatttttaacaagtcaaatcttaaatcactaagcaggcaattagcttaaaagcattagatgcccaatttgtcaacttctgtgggagtttctaaagtcatttccatggtgtattgtgtaagttatgcagagccatattggaattttgctaaacactaaataaagtatgcagtgcaaattcatacaatttgcaaaagttgaccacaattttagctgacaatattccaagaacaaattgttttaagtaagaactggacgctgtttttggctctttaagataatttgtgcaacacctttttattctttgagcagaacagctctctgttatatccttaacctaaatctttaggctattaagcacatagagagtcaccttggttggtattttctacatattatttttgtgcaagacaactggattaaatctaatcatactttttgcagtgatatctcacataaaagagattggaaaaatcattatgtgattcacctctaggaaaattgctgctgtttaaattaataaactgaaaagggatcttgagagaagaccttgaaaatcaggaaggcaagtttaagcagctgataactgaagggggttacagcacgaactcaatgaaaaaggacactgaggccaagtataaaccacgaggaagcatgtctgacactttccccaatgactaaactcatgcataaacccataccctgcagtggactccctaacaagaaatttaaaaactctctatactctgtcctaacctacttttttactcttatgtactgctatatactctcctttacagtagcaatattcctataattttctgtctcttctccccagttcttacatgtaatgtacctttgatttcagagatcatcttctaaaacacctactgaagtcctatctactcctcactggtttctacagggagttcttccaacaaccctgctcaaaagtaaagtctcacttttcctttttccaacagcattttgagtgtttttcaatataatcattttatttatgtgcatcccccttatgatactgttagaatcctgatattggcaaatatatctcaattttttttctattcctgatagtaacttacataggacttatcaaatagagttgactagactataaatgagcaatttaattcaaaacacaacatagtttgattagaggcctactgttttccaggaaggtgtcattctagagactctggaggagattttagcatttagctctcaaggcacagctaaagttctctatgagctgaggttgctggtatctacctcaaactcaggtcaacctatattttcccaacagcagtgttactgatatttaaagtgtgaaaaatggccatcattggagatcattcgatacactgcaagatatctggcattcgtggacccaggtctgctaaattcaataccaaatctggcgcactgtgacagccaaaaattggcaccacatatgttcagctgcctcctataggaagacacagtagaaggccagtaagtctttaccatgttttagtttcttataaagagattgtggaatgtgtacaccatggaaactgtgtctagggaagagagaagtaagaaaagggaaataggagagatttggttaggttatttctatgagcactaataacattctggatatcagagcaatggcagcaattacacagatgaaagttgtggctaccttcacagctcctactcagcattctctatgctagcagtggggaattatgaagagctaactcatgactatacaggacaatggcataaacagatacacaatgagctctcagacagtttataattttacctaaagaacccagcccttattctctagcttcatgcagtgtttgctcttggttgtatcgctttccacttcatgaaagcagagataataaaaaagaggcagaagtgggacagacaaagagacctcctacacacacacacacacacacacacacacacacacatgcacacacacacacacacacacagtatcaggaataatatgggagactcctgttgtgttggctgtaaaaacccgctagcttctgtggtgtgattcatcagaacaactaaaaaatgtcagctttctcagagctagcagcagaagcataccaaactttaaataaaggatgacaggaggtgacagcacaaagagattcaataggaactataaaaattattccctaatttctacccagagcttaaccctagtttaaaatgtttcactgggtcaaagacatttcattgtctaggcaataataaacagtccctatcatgacaggaagtttaaaggtctcccttcttgcttttttctcccttgatcccctatccccaaccacaatcacctttctactttttcacctccggctttttattggatccttgctctatttatctagatttatttggcttcagtcaagccattttatgcctctttattccttttgcatagcataaaaataaataaggcaaggagaaatagccccgtcctgcttaaaggccctcattccttcttttttcaaagccttaacaaatcatcaatgagctcggactaaaggtgaattctgtgttctgagacaagagatggaaatggcaggatattaaaacacaactgcagataacagtcagaacctgcctatatcccgagtgctcagaaaagagactgctccttaaagaaatccttgacagaagccattattaagtcagcaaatccctgctaatggaaaagggaccacttacagtggagtgtcaggcagatagacactcacatggcacaggtcagcactgtatagggaaagcagtcacattcttcatctgtaaacaaactgccaagaaagactttattaaaaaaaaaaattctgggccgagtgcggtggctcagcctgtaatcccagcattttgtgaggccaaggcaggtggatcacctgaggtcaggagttcaagaccagcctggccaacatggtgaaacaccatctttactaaacatacaagaattagctgggcatggtggcgcatatctgtaatcccaactacttgcgaggctaaggcaggagaattgcttgaacccaggaggcggaagttgcagtgagccgagatcgcgccactgcactccagcctggcaacagagcaagactccatatcaaaaaacatttaaataaaaataaataaaataaaatagtaaataagaaatagacaaccaaaaaatcccaaccctcaaagtgcttactccctagtggagaaacataaggtctaattatgtccctcctttgctctaaaacccttcactgtatccctactgatgaaattaagaacaaagtcttgatcattgtgttcaaagcctcatataatctacttctgtatttactaaaccactaataagacaccttaatgggtcttttctattctctgcaatatgattacaactcaagaactctgctagtataaatacctctcttttcatttcttgtctcttacttttcttgttatggactccttccttccttccttctttcttttctttcttttctttctctttctttctttccaaatgttttgttctgttgcccaggctagagtgcagtagtgccatctcggctcactgcaacctatgcctcctgggttcaagtgattctcctgccttagcctcctgagtagctgggattacaggtgcctaccaccatgcctggcttatttttttttttgtacttttagtagaggtgggttttcaccatgtcagccaggctggtcttgaactcctgacctcaggtgatcctcctgccttggcctcccagtgctgggattacaggcataagccactgcacctggcctggttatggacctctttcaaggtataactcagttactaaattttacatagagcctttgttgatcttctcatttgcaattaattactctcttccatgatactttcttatagttcttatacttcttttataacacttggtttaataaataggtcaacatagtcaacaaatctttatcatctactatatgcgggacaccatgctaagaactagtcgctgcctttcaggtgcacaaatctagtgatagacataaacacagtagtttatagaggtacctaggataacacatggattgatgagagcagcactctcaataatgatgaaggaagcattcttgagtaggtaacaattgagtattacaggatatataaaagtcagccaggtgaagagaagagaaaaagcttatcagggacaggtatagcctgagcaaaggtaaaggtccttaaagattatttggttattagtaaaagtgttaggagaggcctgatcctggaggtctttgctatgccaagaaatgagcttaaccctatagacaactgggagtcatagaagttaagaaaatgaatgatacaatcagtccattatatcaaaccggctgtggagtctgcacaatggatttgaggagatgacaagcagaaatagaagcattaaatggtcacagtaatagtccacagagagatgaacagtgttgaaactaatgcaatggcagtcaggataaagaaaaaccacagacttaaggactctataatagagtaacctgggtaggaggatgactggcagatgctggcaggtgaaggaaagagaacaatctaggctgatgtcctggtttccagcagtgacagctggctagatgatggagttgtgaactgaaattgtcatttcaaggagaaagccaggtcaacacaaggatgatgatttcagcctgggaactgctgaagggctcataaagagctcatttcattagtatttgtcctatgcttaattacttacctgaatgtgtctttctcactagatggtatgatccttgaaatataaaaatatcttacatatattttgtccctcaaaggatctagcacagtgctttgcacatagtaggggctcaacagttatttgttaaataaatagagaaatagaagactggataaggttttggcagatcccattacgtttctgggccttaatttccaaacccataaaatgaatatttgtcctaaattgtttctatattcctttctaactttaaaattctatgaaagggccatgttctctaaaaggaagaattgtagaataatatgttacttttattgcacaatttcttgcataaacagccattgaaaatatgtcaaaacatgtgtgtgtaatacgaagctgaaaataaaaggagacgtttgaaataggaaggccatgatgctcaccctataaattatgaagcctcaaacactaagagatgaggtttaaagcaaataaaaatttatctaattcatagtcaaatgaaaatcagtgcagaggagccctgtgtggaattcaaacagcaggaaaatgttttttgttgttgtttttgttgttgttattgttatgttttatttttgttttgtaagtgtgtgccattttattcaaccttttaaaatgatgcattttccttttaatggtaaaagatgaaatatgatacccttaaacttagttcttctctaaagaaattgcttgaaaaatagtttatgcttagcacatagcacaggcacagattctagtctacatttttcaggcatgaaagacacacaaacagacaagtataagaaagaaaaatgaaatctctccttctagaataccactgtactgaatggcgtatcaggaagacacctgatggggcatgctaaatgatctgtcagaaataaggtctataatgtgaaaatacaactaaaacaagccaaaaattaactctgagttttgaaatgaggtttttaaaaattaaccatataagaatagaatgatttagctaacagaggaagtaggatgaagactacaaatgtcttgaacttttgtattgtttgggaaagtaagatgccatccccatgtagatgcctgctggggtatgtctggaagtcagtgagagggaaacaacattgtgtcaaatgtctaccacatataataagtactttacacgtactgtctcaactgctgttcacaataactctacacacatttgtatgtgaagacactgaggttcagtaaatttaaatgtcctgcctctggaggacacacagtaaattgtgtgtcaggtagaactgtgtcccatctcagacttaagccaccataccatgacaacttgaagccactgtaacttaaactcaatatatctgttatgtaagctttataaaagtatttataaaatataatgagcagaatataagtttgtggagccagttgaaattgtattctaatcagctccatcacctgacagctttatgtctttgaacaagtgacttaatcctcaaagtcttagtttctttgcccataaagtggagataatataaaatctatattacaaagttgttataaggaataaaaggataaagggtatacaaagctggcaaataggaagggttcaagaaatgttagcagttattattagacatatcattggtgttaccaatgtcacacttgggtttcttgaactaaaccaactggctgatttccctgtgctttttcaaacaccagccttgtcctggaatgcccccatctcttcttgttcaacaggaaaattcttaattcataatctgagactcagctcaattgtctcattctctgtatcaccttttctgaccctcctcaattttgctataaaaatttaaagttacaaatcatctcatttgttctttcattaatctcttcatatatttccactatatctgtgagacttttgttatcttttatttatactctgcctcatcttctacactgacacttcttaaatctgtcatttgtatctactataacacctgaaactcaattaatggatgtgggtaaaatgaataaatgaagaattgttaaccatacttctaataagtaatattcaagctatattattaatacattgagtgtttgtatttttaacaaaaataatatctatcctattagttattaaatattttattaaatcagtgtttttattcaaagactgctgttattattacctataagtagtacaatataaacttggtatgaggataaaaatctaacctgtgaatcagaaaatggggtttctaaaataagctctctggttgaccttaactaggatgaatcacctctcttgtcctgtctcaaatgtccttagcatgcataaaaggaggccattacactaaatgatctttagggttcctctgaactctaacagtgtgtggcattagagttctctgttggtatctagtctagtaaataactaattaagtactgagaacactacactccagcttgttgcctgtgttctcagaccagagatactcacgccagaatacagaattttaaccgatattcaccaaacatgaaataaacattcatgggtttgcactacaaaaagaaaatcaaatcatttttctgaagatgttactcacaggtatcaatataaactatgactttgtcttttaaaggtgtttccatgaagagtcaatcatatatctgaaatatagatatctaggccaaagttcataaatccttcaatatcaattaatgattaaattgcacattatgtctttactgatattttaattccaaaacttttttactgagtcaccatcagaggatctggagtaagatctgactcattctagaaatccttttggttttgtgatgcctgacccagcagccagctttagaaaagtgcctacccctgaagaaagcagctgtgatgctaatataaaagcgtctgtacgaacgtggagaaatgcaatattttatgctgtcgattacactgtgagctcctgtgagctcatatggcaacgactttgtctacaatattcagaaccactaccagagtctaataagcaatgacatagcattacacacatagaccaaataaattattttcccgcttttaaatagaatcaccattttctggcaatttttctgtctccaccatgtttttggagatagagaatcagaaaaccactgatcttgtaaaaattttattgtctgccattcctccagtttcttaagtctaattcctactctgtttcccaagccaggttttcatagtttaataatactcagtatgtcaaacttcagccaacagtgggttttatggcgtttgaataatagactgtcaaagtatttccatagcctttacatatggctatggaaagtctatgaaacttagaacagatagacttccacgattctggttattgttttcactttcacagtgaactgtaatctgtgtcttgcagacatgtttatttttaacaccataaaataagaatacaatggatgtattctttgctgattaacataaatattttctatcatttctttcctaaattagcactttcaaggttcataacgtgaagagtttcatattctaaagcatgtgagaaagttaaattaaagcctccactttaaagaaacttggcatataaaaatttttccttcaagataaattagtaggtaataattttctttacaataggatgcataaatatattcttttatagcagtcctcttagcctattgaaaatattatttgttatgaaacttgatttgtgcagacatcttaaatttttaaaaatctcataaacaggatctaacttatatactgtcagaagaaatacagatctatatggcattacttgagaggtaccagtggcttctactcaaagatagtctctcccttttttcttccattgccagattctaatatttgaaaatctccatctaatatttgaaaatttccattcttctttatttcattaaaaaactttagctttaactaaatacatatagggcattcctcatttctgtgccagaccaagataatgattttcaaaagaaataatcaaaaaccactacttggctctgaataaaacctcacatccataataaaggtataaaggtcaaaacatgtggagattagggaaggtttattggagaggatttatataaagaatctggaattcccattctcctccctactttctcactccatagtctagaaagagacacttcaatggaacatttaaaagcaaagtccctggcagctgagattcagtggacacttgtgaactctctcccaagaaatctaactagtgaaaggaggtcggctacttgctgatgaataagcagaaaaagatgtgaatgaattccaacatttgagcatttttcatggtccagatatgggccttatgctaaagacagctggtctggggtcaccttgtttttttgtttgtttgttttgtccaaggctattgcctagatcagtaaaatagagaaaagctacaaggagttatagaaacatctggatttcataaataagcagtcagctgcagaagaagatatcactcacattaagtgaactgcaggtcagatgcagacctccaaggaaccctcaaaatcacctgtgacatcaacttgattgggttaaaagatacctaggtaactggtaaaacattatttctgggtatttctgaagctgttttcagaataaaattcgcatctggataagtagacccagtaaagaacaaaatgcctccaccaaggtgaacaggcatcatctaatctgttgaggggctgggtagaacaaaaagacagaggaaggacaattttgctctctcttctccagctgtgacatgcatcttctcctgccctcagagctctcctggttcgcaggctttcagacatcaggacttatgccagcaccctccctcaccccttaaccttgtactaagcctttggccttggactgggagttacaccattggctcccctggttctctggccctcagatggggactgaattataccattggcttcccaagttctccagcttgcacacagcagatcatgatacttcctcacctttataatcacataagccaattcccataataaatctcctcttatatatgtatcctattcgttctgtttatctgtagaatcctggctaatattttatctgtgccagattttttccatttgcccctttggatccactcatcaccttttttcaccacactctcttcccccaacccccagatatcacaaaaattgttccatgttttcaggtgagcttgtgcaaagcaagggataggcagggaggaggagagtagggttgaaagatttattttcttgttgccattccaggtagttgctgtaagttggttgtgtctgtctactgaagaccacaactcctggcagaagtcttcttcctacagccaccctgtcttgttctatgacccactccctccccttgatcctacaggcctgggagtgggcagagctccctgtagttgcaggcctagggtcttgctctatcccttattgagtccctcaagccttgttcatagctatataaataggccctttaatatactctcctcaaattaccagcttggggcactgtttttttttctcttgctgggaccctaactgatacagcaagtttatgggaaaagtcagccttcagaaacctgagagctagaaataacttttatgttcccttcagctctccttcctcctcttgcttctaccccagaaaaggggagaacaataataaaaagcaattaagttctctttcaactgctggtttcctacctacaataggtctaagctgtggaaaatcagcccaattgaaatcaaggtataagttttgacagttatattctagttattgattagaagagagggactggcacaaaagactgaaggtaactagaaaagtttggccattgattgacttttcagccagggtgaagggaataatttacccaactgtataaaatcaatgagacaagaaacaaaaatataataacttcattttacctgttttttaaacatcttagttattttagttttaaattccaaaagctaccttggaaacatcccacatatgaaatatgcattattgggggaaaatacagtagaaagaagagagtttgttaagaaatatgtagaatattgaccattcttagagggcaggcctgacagtggtgttcaagtcagttaagtggaaagaagggcatgaaaaggaggacaacctaagggcaaagtccaactctacagcgctgtctcagacttactcagagccctgatcacaggatgatgcaaatttaaaattcacaatgcaacttcaaagaaaatccttctctattcaaagtgatattcctaagactaattccaagtacatctttctaagttccttttttcctgcaaaatactgatgtggagaaaaaattaaaacctctacttagtgagtcagaggagaggcgattcctactcctaacttttccacttcctagatgtgtgaacttaagcaaatcacacagtttctgtgggtctcagtttcctcttctgtaagatggcgtgtagaaacagatgtgttgatgtctcgatcagatctgatcactatgtactaaatgttactattggtggtgttcattgcctctcggtggtatttccctacaggaaagagcatttttattttactctataagagaaaatattattagagtaataccccctggttcgctggtctgtctgggtagcacaacttacttagggggtgaggttggacagaagttggagacgacttattcacagctttatctctattgggcttttctctttctccttctgcctctgtctctccttcctctccgggaagtgctaaataagttgtctttaatgtagggaggaaggagtagcaagcccctttatgaccaagacctatccccttgtctagttttgttagttctagttcctgtagttcgaaggggaggaggggcaagtgacaagccacaactaacgcacagaagtcggtagaaattggtagcaaaagatattcttgttttcatttcaaccagcaagatttaaaatgaagtatcattctggttacaggacttataatagatacatgtttcaccacatccttgcaaaaatgcagatttagtgagtgattcttctacaatcaatgtgcagagatttctaaagtaattcagtaaactgtaattaatgttattgaacagagcctggagaacacccatgtatctgagagacagaactaaatactgtctatgcaaaaagaatctataaaataaccatttgaaacacacttatgtatccaaagctgttactaccactattttaccatgttttcaataaatatatatgctattcttcatcttaggtttacaagtcaaactaggaaacatctatgtttcattattaattagcactgaacaaaactcagtaaatttcacttaatcaatgatatcatctagtttgattcagaggggttcagaatcttaagtgttagacttttatttctttaatgaccaccaccctccttcccaagggtcaacgttccccctcactgagtgggtgcaaactgacatacccatcagaaaagatgggcatttggagagccataaactaagcctctctgagcagggtgatttggacagggtgctatatatcagttccaggcgccagggaggactgatacagcagcacaaagctcccgatgaagcacagcccagttgcaggagattgctgtgatgataatcgccagaacaaaccataaattctggactcagaattaggaatggcctgtaaacatcaaataatgggtgtctaaattgaaaatgaaactatttgttgcctgtaatatttcttgcagtgtggctcagagagccagtaacattcgagacaagcgtgatctttttcaatgtctgttgttagaaagctgaggatattaactcctccttccatcaaccccagggaaacagagctaaatgaactagctagaaatcatgggacataaaatatagatttaacattatgcagcaagaacattacaggttaaaaaaaaaagaacagagaaatacaagtactgcattgaagaaccatactggcgagcactgaaggaacaggctcaaatagtttactcagggccctttcacactcactcatatacattataaaatgaaacttgactttcttgcatctggtttaagggggtgccagtcaacctggtgagaatctagattatacaaccacagacatgacatttggggatccataataattgcagattgggagataggtacttgatggattttttaaggcactttattaaataggaagaatcgtgtctaataagcacagttttaatttagtaagatcttttgttataataacaagtgcattgttacaagtgttacaagtacatgaacaaatatttttctcctgccattttataaataaaacatatttttgctctatttatctgcttactaaaccttttttttgtttatttgtttgttttgttgttgttttttaagtctcactcttctcgctgaggctggagtgcagtggtgcgatctcggctcactgcaacctctgcctcctgggttcaagtgcttctcctgacagcctcccgagtagctgggattacaggcatgcatcaccacgcccggctaatttttgtatttttgttagagacagggtttcaccatgttggccaggctggtcttgaactcctgaccacagataatccacccgcctcagcctcccaaagtgctgggattacaggtgtgagccactgtgcgcggccacctttgttcttatcaaaagaaatgaaagccaagatgcatagattaatgacatctaaattcacgaaaatttaccaaattcatgaaattactgttactcctgctaaatcaatgtacacatatactccatttgaccaagatctttttttatatataataacttgtggaagaacagaagatattgattcttgtgggttctaggtactgtaattaatagaatattttccatgtgagtataggcggatattgtgtatgaagtagttaaatagtaatgtgacgtggggatagtgatattcaaaatgtttaacaaacagaagtgcagaagtgcctgagcaccagcactcccctgcatggacaaggggcatttgggagctaagggcagcaagataggatctatttgagtatcatccatagaaaagtatgtatttaagaaatcagtgttcaggtagggcaggatactgaatgttagctcagcagtactctcgctgagcaattgctgatggaggagtgaagggaaaatatattaaaaatgacacagaggacatgcaaggcataacggggtgctctttataaacattgtgcctcaattaagaggtgtctcaatgaaaagaaaattccctatctccaggactatgactctatagactaaaaatactcaagttaaagaaagctaacagataaaaatattatttctggctgggtgtggtggctcatgattgtaatgccagcactttggggtgcccaggcgggtggatcgcctgaggtcaggagttcaagaccagcctggtcaacatggtgaaaccctgtctctactaaaaaatacaaaaattaccaggcgtggtggtgcacatctgtaatcccagctactcgggagactgaggaaggagaatcgcttgaggcagaggttgcagtgagccgagataacagtgagccgagattgcaccactgcactccagtctgggcgacagaacaagactctgtctcaaaaaaaccgtttctcaattaacaagtaaaggtgtagccaatatgttgcagagaatatgagagacaaaggctaaagagtatcaataatataaacaacaataatatcaaatgttaatggtttacttataatgtgccaaggcctggactaagtagtctataaacatcattttactgaatgctttcaatggccccattaattactggtaattatatttttgtggtatgccataactaatcttattatatgagtatattattctcatcttaggatacagtattggtcattccaaccacatattttaatcgtcttaacagaatttggaccaaagaatatcttcatgtccaaaccaaactcatgaccttcccaccaaaacgtggatcccctcactgtcagccgtgaagtgccataagcccaaaatctagaagttgcccagactcctgcttatccctccaattgtacatcaaaacctcttatttacttctagaatccattcacttttacctttaccatcgccattacctcaattctttattgcttaaattaatctcattattccctaattggcctacctgttactttttaccctcccagtgttcaagttaatgtcctagcccccactctacagccagtgtgatcttaaaataaacaaataaacaattagaatttctctttgtgtgatacccatttgtttaaaatccctctgtttacaatatgctcctctgtttaaaactccatttaaaaccccttaacgggttccctttgaaggattttaaacagggagtcaaatccttaacacatcctaaagctcctgtatgatctggcctctgcctaaccatctctccagctccatctcaagccacctcttctctttactctttgtgttccaaccattatggctttccagatagttaaacatgtcattcccttcttctccacagggctctggtcatactgatccctcaatttggaattattttcccattctttacctcctatattcttatcctggttatttcctactcattcttccaatctcaattccaatgccacttctgccagaaagccttcccaaactcagcacttacaaatgcttaacacagcttgtaatgataaactcattttttgtaattaattgattaatgcatctctcccccaatagatatgaaaatactagcagggaagaggaataaatctgcttttattcactgctctcctcacccccagcatgtggcatatgccagacactcagaagccttcataattaagtactgaatcagttagtgaattaattacttgtttttataagaatactgaggatttttagataggcctccttacaatcaaggttttctcatcagagttagcagtagtttgtgaaagatactgtcttatcaaagctcatttctatatcgttgggttatatactatacttatgcactataatccgtatacatataacttgtacaactgcaaagtgtataatatttcactgaaaagatataacatcatatgaggaaaaacaccacttctatagaactattttgtaaaataatttttaaagactcataaattataagtcatgatgacacatttacctacagaaaatatttcatcatttgcatgaatagctttaatatgccacatgctgatttaaaatatcttactctctaaaaaaatataacctcctttaacatttaccttgtaaaagaatcattttttttctgaaaatgggtaatctacatttggtcctgtcttgaggttagaaaagacatttgaagttaacaattatttgtaagaacaactatcgtcatgatgtctactaatattcctcgtatttcattattttccatttgtgattcagcatcaataattcagataaagcatattttttaagtgtcctagagtattatttctcaaatcttaatttgcataagaatctcctagaagagcttgttaaaatgtagattctaattatttatgtctaggtggggcctaaaattctctatcacccacaagctcccaggtggtactcacacagcaggtacacagaccacagtttgagtagcaaggatgtagagtaagtggaatactccaatctaaatccaacactgttcagatacccagcattttctgttcttttgcttttggctttgagttctggcacacaactctatacaatccacttaatgttgtgaatgccaagaatcaaaagtcaattaccacttggcaacatgtacaaactttctgtttttaaaatatcaaaatctatgctggagtagtagctgtaatattaggcaaaatcagagatgatattatcaggagtaattatagtattctaaaacaaacttctaaagattgcctcatcacctaggtctggacagaagtttgattaaaagccactctatttaggtaatcatcttctctagaagtttacagagatgttgaagtgttttcaattatggctttttattggccagtaaagtatgggagacaaaaaaatcttaataaatatgtacagaaatcactttgttttataaatgttgaaactaagtcagaaacttaccaaaattaaatagctaggtaatgatagggctatgagaattaggtttgtaatctatttgtgttggatgtccaatggtaatccacaggtgtaatgaggttttggggggagtaggtttttgtttcattttcttgtttgttgttttaagacagagtcttcactctgtcacccagactggagtgcaatgatcacagctcactgcagcctcgaccttcccaggtgcaggtgatcctcccaccttagcctcctgagtagctgggactacaggtgcacatcaccacacccagaaaatttttttctattttttatagagatgggcttgtgctatgttgccaggctgatgctgaacttctgggctcaagtgatctgcccacctcggcctcccaaactgttaggattacaggcatgagccactgcaactttatatcctgaaattcctaccatgaaactggcttccaatattttttttttgcttaaagtaaacttgtctaaataatatttacctacttgtccagtatctattatacaccaggaactatgctattcctctgtataggtattttatctagtttagtagccactctgaaattgattattattatttacctttatagtcagataaattacaatgttttcataagtggtggagttcacattcattacactttactatacactatgtatttgaaatgtttataagtatttttaaacattttattgtaacttttttttaacttgagctgttattgagatgtctcttaaatagacttatgatatctgctgcattgttgtgtcagtacagtcataattctgcaactacataaagaacaattctatttattccttgtactgggatcacacccttggcctttctccatactggaattatatcagcttggttttctcattagctattagtcacaaatatagcaatacacaagcaaatttggaattttgagtcactgaattcaaactttccccctcaccttctgctgaggcttccacttaattacagactagtacgttttaatactaagcatttaagattaaattacctggccagaaatagatcctgaaaaggctggttaaagcagaactagggcatggtttagacagacacagaggcaacatgaaaagaaaattcaaaatgtaaataagccccacaaaactcgagtaagatgcttcaaatgtggggccttaaacaaccaccatcctttacataacaagttgggaaaatgtcatagataaaaatcaagtacaggaatacctcaaagatattcgggttcagttccataccaacacagtaaaagaaatactgcaataaagcaagtcacatgggttttttggtttctcaatgcatataaaagttaagtttacacaatactttagcctcttaagtatgcaacagcactctaccacactatagtctcttaagtgtgcaacagcattatatctaaaaaatgtacataccttaatttaaacatatttattgctaaaaaatgctaacagccatatgagccttcagcaagtcaaaaccttttttgctgatggagggtcttgcctcaatgttgatggctgctgactgatcagggtggtggttgctgaaggttgggtggccatagcagcttctgaatataagataactaggaagtctcctgcatcaattgactcttcctttcaagaaagagttccctgtagatatttgagagttttttactagcggtagaacatctttcagaactggagtcaatcctctcaaaccatgtgtctgctttaccaatcagtgttgtaagacattctaaatccttttttgtcatttccacagtgttcaaagcatctccaccaggactcgattgcatctcacaaaacaattcctttgttcattcatgagaagcaactcctcatctgtcaaagttttatcctaagattgttataattcagtcacatcttcaggctctacttctaattctagttttcttgctatttccaccacatcctcagttactttcaccattgaagtcttgaagcccttgaactcatccatgaggtttggaatcaacttcttccaaatgcctaatataatgttgatattttgacctcctctcatgaatcatgaatgttcttaatggcatctaaaatagtgaatccattccagaaagttttcaattaactttgcccagatgaccagagttattatccatggtagttatagccttatgaaatatatttattaaatagtaagacttgaaattcaaaattactccttgatccatgggttacagaatggatgttgtgttaccaggcatgaaaacaacattcatcaccttgtaaatctctaacagagttcttgggtgactagatgctttgttaacagtaataatttgaaaaggaatccttttctgagcttcaggtgtcaatagtgagcttaaaatgttcagtaaacggcaacataaacacatttgctgtcatctaggctttgttgttccatttacagaatacaggcagagtaggcttagcataattcttcagggccctaggatttttggaatggtaaacgagcactggtttcaacttaaagtcaccagctgctctagccaccaacaacagagtgagcttgtcctttgaagatttgaagccaggcattgactactcctctttagctatgaaagtcctagaaggcgtcttcttccatgagactattttgtctacattgaaaatatgttgttaagtgtaactacttcatcaacgatcttagctattatcttctggataacttgctgcaccttctacattagcacttgctgcttcacctggcattttcatgttatgaagctggcttctttccttagacctcatgaaccaacttttgctaccttccaacttttcttccgcagcatcctcacatttctcagctttcataaaatcagacagttagggccttgcagtagattaggctttagcttatgggaatgttgtggctggtttgatcttttagccagacctctaaaactgtcctcatatcagcaataaggttgttttgctttctcatcattcatgtgttcactggagcagaactggaagagttcctacaagaacatttcctttgcatgcacaacttggctaactggtgaaaaaggcctagcgtttggcctgtcttggcttttgatatgttatccccactaagcttcatcatttctagcttttgatttaaagaaacagatgttttactcctcctttcacttgaacacttaaaggccactgcatggttattaattgacctaatttcagtatttctgtgtctcagggaacagcaagcctccaggagaaggacagagattggggaacaccagttggaagagcagtcagaatacacacccttatcaattaatttacccatcttatatgggtgcagtttgtggccccctaagacaataacaatagtaaaataaaagatcgctgatcacagaccactgtaacagatataaaaataatttaaaaatttaaaatattaaaagaattaccaaaatatgaaacagaggcatgaaacgagtttatgctgttggaaaaaatagtacttgcctgaagcaggatttccacaaaccttcgatttgtaaaaaccaccatatctccaaagtgcaataaagtgaaactcaatataagctcaaaataaattatgcctgtatgaatgcaaatctaaaagagagcagtcagaaagaccaagtaggtattaacaaataatgaataaatcaataagtgaatatatgaaataaacctcagctgtgtccaaaagcacaaaagcttctgaaattataagccatgtaacaaactaaaactgatctcagcaagatgatctagtgatcactccagcggaatatcaatgctttagcctagtacacacatgttctgagctgtgaaggtttttcatgattattatttttatccttcgtaattatctttcagtttatatttctagccttgaaacacataagttattctttgcatttagagcctattaacacaatttcaagaagaaaactacaataagcagggcttgtaaatttgttttttttttcctactgaaaagcaaagagaagtcgatttgttgacaacaaaagtgcctcaagtgattatgttttctttatttattctcagtgtttattcccaattcctcagtcccaactaaaggtctactacagagagtacatatttcttaaatctggaaaataatttaaatacatcaactaacacttgcatggtgcaaaataccttcagctagttgatgccaatgtggtacttaaactatggttcccaggatggcaatcctacatttccaccacactagcagccccacaagatagagttcactgcctcaatgagttcaaaagtaagaaaaaaaaaaaaaaaacccacatttaaatactaacactattgtgcatgaataaatggcaaaacaaaggaaactaagtgctttccaatggtttaaccaagaaccattcaatgtccctttttctgttcctccttaataactttttccctaggtgaaggttgaaaagaacagtgccattatgacttcgaatttggtgcaaagccagtaacacatattgatactgtcagtagctgtgcacgtgattttgctgtttttaaaggagagctacattttaaaaaccgaggttggagcttgctctctctaaagtgtctgtgattgtccttgccctagacctcaggttacttatttcatctctatttgaagagacagaggcagggttgttcctcagtcaatttttttttcagtctacaaatcaagttaagctcaaaattaacataacaattatttgggcatgtaaaatatgatgaattcctatttcctatctcatttaacattccttccaatttcataatgtcaataaaccagggactaaagcccttgtaaattattataaatttctccatatatgcatccagattggcctttgacaatatcttaccacaaggagactattttcattatacactctatctactttcttcatgatatgtcttacaattagctcagcagagctatccacttacaggttggaactttaaaaaattgctcaagtctccatgaattaaatgaagatttagatgaaattcaatgaagatcaaaagcttagaagtgccaaatctcatttagctaacacatattattcagtctcctctaagtgtttactaaaatacccatggaaacatattttaagttgaaaattgataacaatattattactaatatttataacaatatcttgcagttaatatatttagaactattaacctgtttagatttattaactattaataggataaggatagcttaaaaaaagttaattgatttaaagtttctgtaaagaaagatactaggcaaattatagcacaggtggtgtttaaaggtggaaaaaaattgtgaaaatggtgtaaaagtgatggaagtttgggaaactctggagtttattgccaatgccactattttagttaggtaaatggctgtataactcaattcagatcaatcttagttctttcgacatctaattggaaactccaaatcccagaaaaaaaaaatgggtagaaaagagaagaacttggaaatagtgcattgaattctaggagttgaggtgcatacaggtaaactttgattagtgaagtgatgaaaaaatgattctagtatcagtatatagtgagtattggagtcttttcaccatgtacgttacctgttcaagtctccaaggtagaggtaaaaagtaacatttcagtcctattgagatatatgagataaaagacatatgagataaaaacctgctagacaactacaatttttctataaaccttatgcatcaatctgtcatcatctatagaactgaagggtgattcggccagcatacaagtaaagagagtataattcaaagtaatatatatgtactgtttcttggtaaacaccaaactatgagagagctttctttgcatgtagagtaaaaaggaaaagaaaaaaccacatggcttaaaaattacaaatgggacctaacccaagctttgacagaatcaaaatgatctgccagtgacttaattcactgtcagaacaaacctcaacactcctgaaatgaaattaaaacaatcaagagcttctacaatatatgatccactgtgaatagcttacaataaaaaataaatagtcatgtaaaggagtataaaagtgtgactaataaaaactaaaatagacaatacatataggcccagacattttctaaataatgaagttaacggacaaggacttcaaaagagctgtaattaatatttcaataaaaatgagtaatagagagacaaaatgtatgaaaacatacagtatttccacagaaaattagaattaatcatttatgagatagatattttaaaactgaaaaatagaatatctgaagttaagaacttattattggacagaactaacagtactggacatagaagaatacaaaattagtaaatctgaagaaaagtcaatgaaaaatatttaaactgaagcattgtggtgaggagagggaagaaggtagagacaagcattagagaaatgtgggacacggtcaaaacatttaacacaagtttaataagaatcccaaaaggagagtgtagagaaaatgaaactgaaagcaatatttgaagaaataatggctgataattttccacacccgaagaaaggaaaaagcacacagattcaaaaatctcagtgagccccaactaggataaattcaaaggaaacagaactaagaacattctagtgcaattattctaaagcagtgataaagataaaatcttaaaagcagccagagaaaaagacaattacctttatggaaataataacataaatgttgaacacctttaaagtacttaaagaaaaaaaaaatcctgccaaccaagaattcaatggccagagaaaatacctttcaaaaataagagaaaaagtcattctaagataaaagttcagagaattagttctagatatcacacattatagaaaatactaaagaaaggtctttaagtaaggttgaatcatcagtgtttttgatggtatacagcacaatttggatacaaaaacacatgtacaaatcaaaaagacatttagaagaattagattgaatataaatcattctagtaataatttaacccatgtactctgcttatattttcctctttgttatatatactacactaataaatgataacacaatatgttcaattactcaaaagaactcttttgataaattaatatcaaaagcctaagtgattagaagatgcttatttggcagtgttttattttctttcttagtggtatttcagttaatgatctagtttatccatggaattataggttttataaaatacagcaatactttaaaaatcaaggcagcagaattgaaaaattcaataacacttctttagataaaaaacaatgaaacaggcaaatatttgagacacttatctatgaaaaaaatacataaacaaaataaggcaaaagaaactgatgagataaataaaatatagaaattttcaaatattcctaataaatttgaaggtattgaaatttaaaaatgtctacaagaatataacacaattttctcattaaaaagtagataacaatcaggaaactacaactatataggaactatataaagacatgaataaagagattttgaagttacccccattaagtccttcataactttaatcctacgtagatttatacattgtcttacaagtatttttatttgctgaaacaaataaaaatggaaaagcttccccattcatcctacttgctagcataagcctattcaagaaaacttgacaaaaatggcaccaacacaacaacaaaagatatcgtaagtcttatttatgaaaacagatgaaaaacattcctaaacaaaatataatttttcacatacaaaaaaaaattccagacttaactggctccactagttaattctatccaaaatttaaagaagtcatactaatcttatgcaaaatctctgaaaaaatatagaaaggagcactaagttgttctccacacctctattcaataataagctggaggtcttagtcaatccaatgaggcaaggcaaaaatattagggggaaataaatataaagtacaaagaaaaaatgtctcacacatcgtgatttacagacaacaaaataaaatcacgtgaaattaatcatcaaagtattataactagtaagttagccagatcacaggctacaagttcaacaataaattatatttttatataataaaaataagcaaacggataatggaatttacagacaacaaagtaaaatcatgtgaaattaatcttcaaaatattataactagtaagtttagccagatcataggctgcaaggtcaacattaaattatatttttatacaacaccaataagcaaatggataattgaatttaaacataatgctatttgaaacagcatcaaaagttataaaatacacaaaggtaaatgtaataaaaagtttaaaactttactctgaaaactatgaaatatttttgagacaaagtaaagcagtcaaataaatagatccctatgccctatgcatgtattgaaaatgtaaatattgttacgttttccaatctgccaagattactcaatggattcattacaatcacaattaaaatccagcaggcttttatttcagaaattgacaagccaattctaattttatgtggaaatgcaaagaatctaggatggacaaaagaatctcaaaagagaataaagtgaaagaataatagaacctgatttcaagacttcctataaaactacagtaattaagaaaatttcctattagcaaaagtataaataagtacatcaatgaaagagaagataatccagaaagagattcatatttacatggttaataaatatttacaaagccttcagagaaattaataggaaaaaataagtcttcaatatgtggtgctagaaaaactagataaccatattttttaaatgaacctcagtccctttttaataccacaaacaaaaattagtttaaaactgtccataactgtaacacctaggagcaaagagcttcttgaagaaaacataacatgtttacagtattggagagggcaaagattttttggatatgataaagaactacttaaaaatgacaaattaaattacttatagaaagataagaatatgaataagcatgacacaaattgagaaatattattcacaatgcatatatctaacaatggacttgtaagcagaatatataacttactctttcaacacattaataggacaaataaaaaccataaaaagaagatatgcaaatgaccaataaacacatgaaaaattactcaacatcaaatatcattacagaactgaataccatctcaacacccactagaatggctaaaattaaaaagactgaccgtaccaaatgttggcaaggatgtggaacaatttggaactctcttacattgctggtgggagtgttagatggtaccacgtctttgaaaaaagatttgtcaattcttacaggaataaatacatgtgtatagccagataattctacccagcatgtgtccaagaatattaaaatatatatcaaaaagaattgtacaaaaatattcatagccatctgaatcataatagccccaaaccgaaaaaaaaaaaccctcaaatgcccttcagcatgagaatggatacatttgctgtatattcattcaaaacaatactagccaattattaaaatgttccaacgattgatatagccacgaatgtggaggaatttaaaatctttttctcaatgagagaagacttacacatctagataaatctctaaatgggtaaaactgatttatgttcaaagaaatctgaaccttgatcatctgaggggttgtggtgtataagatttgactgtaagggggccccagtgaacttaatggtatatcggaaatattcatttttttttagaaatatgagttacacccatgtacatatttttcaaaacacatcaaactgtaacatttaagatctctgcatttaatttaaacatatttcaatttcaaaaatgcaaaggtgttgcatcgtttttatcttcttacaatagataatttactttttattttcaggcagggcaattattaatccatttggtttggttctggatttgtgtctcttttcctacctctaactctcatattttacaatccgccgtcatcaactacttacaattccccaaacttacattagcacatgaattctgtttgcttggaatgtccttttcctctttctccacctacacaactctcacttcgaatttctgagactctgcagagacctcacttcctttccaaagtccttccttctctcaggcaaagttaatacctcccacctctgttcaattctgcactgcataccagcatttatcactacacattgtatattttgagagtttatttgcatgtctctcaccatatatagtccttaagggtacagaccatagctacagatcctataaagcaacaataacaacatgaaccatttattgaatagacacttattgcaggcagagacaagcaccttgcataaatatctcatttaattttcaccataatccccattttacagatgagcaactgaagcatagagaagtttattgcccatcaataatcacaaagctagtgtactgaataaagttaattttaagcttttaattttcagctctttctgattccaaaatccattctcttaatcactaagtaggattaactacctcttaaatcttccatttaaaaacaaaataggcatgaataatgattgcatttaacttgccaacaattttttgccttcattatgacactgatatacaaactaaagcagttacaattaaaagatgccagttgttttttttttttttaatttaagcagtggtgtgcatgtattgtttttggttttcatctgttgccactgacatttgtgaatatgatcagacaaaagtgtattttttttacctctactaggtgtctagtttattgtttttccccagaatactgcctactataattggctctgtgtatgacacctatctgtctgtggttcaccccctgaaaaagaaataatatatttcaagctcttaaactggtttccagaatactgaaacttgaccaacccaaaacttgctggttttatgtttcaagcagttagtctaggttttatatattgttttattttgtttattaaatcgtttggctttgtgacattggccctggtctctccagctgccccagtgcctcattagtgaactccagcatcatccctacatccgcgcatctgtatccttgctcagtgtcacttctggaaaaactctctgttctgctttcctaatgataagaacgatacctcaaaccctctctcctgcaccccacatgtcccttatttgccttttatgtctacaatatacactttattttgccttttttctttgaacaatctctgagaagactagtgaaaagatgatccttcctttcctaaaatactagttggagaatataatggcactattttttctaaaggggtactgactagatgaacgtttattaaacacctgtaacataaaatctatattgctctccctagttattttcagacctaatcccgttgcattgtagttgtcattaaagctcaatttttagagattttatggagttagaaattggctctatttagctcctgtttagaaaagagttaacatagcaggagtgaggctccttttcttataaaggcatgtttgcaaggctggcccttgactggaacttgggagcttgaagagtaaacagtttctatattgatacaaaattttccccaattgataagagtagttcacagtgcctaaatgtttgtgcaaataatatgctttatgttgaatacctattttcctacctgacttatgtatgtgctcagcagagggtgattacatgattagctcccaatagaaactttggacttctgtgctcagccaagattccctggtgataacatttcacacgtgtcgtcacaatttgttgctggaggaattaaacatgtcctgtatgactccactgggagatgacctctggaagcttgagactggattcttctaatctttgtcactttcatcttttccctttgctgagtttgctttgtgtctctttgctataataaatcatagccgtgtgtacaactatatgctgagtcctgtgagtcctccttgcaaatcatcaaacctaggagcagtcttagggactcctgacacagctaatgttcagttttattctttaaaaaaaaaagaaaaagaatattcagttaaaaatctcatttgtttgaagactgaattaattatgtgttcatgattttttcactttctgtctctagattccatatatatacacatatatatacatatatatttatacatatatatatatattatccttcaattgtattcttgattatacaagtaaataataatggtaatttatgggggggagaaaaacataaggaaggattttctgagatgtctatttttctcagaaaattcaagctatctcttttatagattcatctgtaagctcaaattttaagaggaatcattagatccagataacagtcagaaagtacaagctgaggttctaaagagttggttcctttaaatagtcatcatcctcagcaggagataatgttttgaaagagttataatatttatttttccaggaaaagaaatgcacatctgtgtttttgtaccaggaggctgagagaatgaaatgtaacagggacagtgtgagcagctagaaaagtatttatcgatcaagttcctgtgatacaaaatgccaaggaagttttttcagctttcacatttacatttcattttctaatttgaatggattagatgatactcctctcatactattcataagggtaatttgaactatttcaaagcaataaaatggaaaattagttgggaaaaaggtcattctaatatagtaacgtaaaatgctcaatgatgaactatcaaataaatagctatttgattataagagtgctttagggaaataaagaagcaaaagagagaagggaaatttaaaaagcattaaatactgaagttagagcatgatataaataataatgtctaagcacatagtatttactgtgtgccagatattggtgtttgtgtgtgtgtgtgtgtgtgtgtgtgtgtgtatatatactcatttaataatggcaaaaatcctaagaggtagttgatatttctatcagtgccatataacaatgaggaaattgaggtttagagagataaataagagtctttaaagatcacacattgagtggcagaaccaaatccaagctttaatcactgtactatgttgtacacttaaagacgaggcatattgtagaaagatttctcaaaattgtgctaaaaattgttttggcttacttaccaaagttttattttataaggaacgaaagtgggtgaagggacccaaattgactattgtaacttttctcacaggaccaaacactgtgccaggattccatacgcagatatactcaatggaaggctaagactttcctgagaccacattctctataaatatagatggaaatatattcatcaatatagagggaaatatatccatctatatttatagagaatgtggcatatatgtgtgtgtgtgtgtgtgtgtgtgtgtgtgtgtgtgtgtgtatacatatatacacaatgtggtatgtgtatataaacatacatatatatattcggcaagtattttgtacaatcatagcttcttcgagtttatagataaacatttcaggaaattgagagagacatctatgttgatagaaaccaaaccagtaaaacacaggtaaatggatgagaggtgactgcaaaacacagagaataggatgaaagctaatcaaaatgacaaacgctaatcaatgtaggcagaaagggcaaaaagataattctcatgaatacttacaaagtatattctgaccttggaagtcttaggttggtgtttatcaatgatgaggccaaaagtttgtacctgtgtaacccagtttctctgagttttgggtgcgcactgtgaaaaattacctacttgttaactgttgtacctggagctcctgcttcaaaaaaagttcagcctcagaaataccaaaactgcttggatccagagatacctgagatgatgaattttggtgaactcccctcactactgtactaaaatctctgcacagggaggaccttattctccattttctacataagtgacgtatgttgaagcatgattggtgactgtgccagcacggcctttactccaacctcagctaaccaacccagtaaaagccctgtttccaccattgttcaaggagggactactttgggaactatccctggtgtcctcttcgtttgttgcaagtaataaaatatccttgttaaatcctccttgattgtggtcattggactgttacctgacaagcaactgaacccacccgttgtgtgggtaacacctgtacttggaaaactaatgtctaactaaattgagtaattagaccagtgtctattagctcaaaactattttccctcactatgagtgagatctctgggtctattttccaaaataaaaatttttaaaatacaaaattcagagttaaaaagttatcttccccaggcctgtttcttcctcagaaagttgaattagaaaaaaagcttgagtttttatatcatctgataagctttctcgcattttttaataagagctatataacttctttaatccactttgactcgggctatcaataaactcattttcaggagtttcccttagtctaggttttctattagtgtgatctcaccactcttgcttgcttggttctagcctcagtatgcttaatttagttattttattgtatttggagttctcatgataagccactgcaacttctcttttgaagtatattaaatataatatgtttatgaaatgaagcgcttaaactgaggataaaaaaggcaggtctcatcggcaaaaatgtaagagaatagacctagagattttattggacagtaagttcaatgtggttaagcagtgtgctgtgactgctaagaagtcaactccattttactcaagctgcatccaaagatgtatattacctacaataaagaaggatatgtccctggcaaagtagttagaccagagcataccatttagcaagtatgtcttgtaaatttaattggacaattttgtttagaccacacatggaatattgtgttcagtgagcaaaagcacactgctaaaaagatatatctgaccatactcagtgttggcaagtaggtaaagcacctgagactctgatacactgctggtgtagatacaaaatggtacatctgtaccttcgggagtggtttggcagttactcaaaaagttaaacatacagtagttccccttatctgaggttttactttccaaagattcagttactcaaggtcaacagtattctgaaaatctcaagtgaaaaatgaacaattcataagttttaaattgtgtgatgatatctcgtgccattctggtctgtcccactcaggacatgagtcattcctttgcccagcatttccacactgtatatgctaccaatccaatagttacttagcagccattttgattatcagatccattatcacagtgtctcagtgcttgtgttccaataatccttattttacttaatggccatcaaaatttggaatgacttattcgcttactggtcatttaaaattatgaaaaaatccaatgataaatataatcaaaactttaaaatgaatcttcaagtgtatatttaaattagtagaagatgttgctttattgaaaccaaattatttcttgcagcatgaatgttataccttgggctgttacagcagatggttgtcagcattggttacctccacgactatgtattatatgaagactctcagtgtcgttatcattttcttgttggaacttgcataacccttctttcttaaagcttgctgacatcatttggaaattctcaaacacttgttctctatatgaactttaaaattgttgtattatgtggtatgtgtgattgtgtttaaacaaaagcaggcaatttgactggaattattaaatacatacatctatctggcaagaaatgacatcattatgatattaagtcttcttatctaggaacatagcatttatttccagttacttaatttttattttatctattaaataatttttaaaatatcggtttacatcatttttactaaaagtattcctaggtattctatatttttattgctaatatgaacggattttttccattactaactttttactttaacgtatttttcttggatctgggatcctcacaaaatattcatttttgttcttttaacagatttgaattgtttagatttaccattgaatcacctttaagtaatggtgattaattcctttttccaatatttgcacagcttattccatttacttaagtgattcactagaaatgctgaatgatatagaatagtcacgctgatagaaagcatccttgatttgtgtcttatattaaaggatcaatcttcagtatttcttaatattatatgatggttttgattagttagacggtctttggcacatttaggaaaatgttttctattcccatttaatttatgtttttacctagaattgctgatttctttttttttttttttgagacaaagtctcgcccttgtcctccaggctggagtacaatggcatgatctcagctcactgcaacctccgcctcctgggttcaagagattctcctgactcagcctcatgagtagctgggattacaggcaactgctaccatgcccggctaatttttgtatttttagtagagacggggtttcaccatgttggccaggctggtctcaaacccctgaccccaggtgatccacctgcctcggcctctcaaagtgctgggattgaattgcagatttttagcaaatgtttttcatgtctctgtttctacaattataggattttgctctaaaattctcttttagtataatgaataatattgatacattattaattgtgaattacctatccatagaatatagcctattttaagcagaggagtgaaagttatagttccaacatctaaatataccaatatagtatgaagatgttctggcttagcagtagttctggcaagcacattagttcccccacatccctaaagccacttctttcccacattccctagctttctggaagatagcaccctccagccagctggaacactgaagtcatcttagatcactctttttctgtgaaccccacatccaatctgtccccacattctgctgattccacttcagaaacatctctcaatttcagatctcccatccattgacttattttaggttctcaatatctctatctctttgcccacagatttcttattgggtttgtggtttcccatgttgctcccacatcccctaaaataactccaacacttcagctagaaactgagtaaaatattttgttacttaaaatcttcaatgttttctcataagtaagatctgtgtaaccaatgaatgctgtagtaacagcaagtatgttagcatgccctccacattcatggtggtcttcaatgcccctctgtcattgcccatgacctccatcccatagctaatcagcctcctgcctatgtgtttctccccacaagcctcttcactagaacttgtgtccttctttccaagaaatctctcttgattcccactctcatagaatgagttactcttagactgttatattagtcatcttcctccctgtcttcatttcatctctacatcctaggtattaagcagagtatattgtaccatgtggagactcagttgggtttcagtgtatatagtggaactttagataaacgcaaattgaaattatcaatgtaggtgctgatttgcaagttaaaaactaaaggtcaaagtcaacagtaagttcacagtatactgtgcaagcactagtccatgtagtatacttgcactaaaatcaggatgtgcattttaaaagaaacagtgaaaaattagaatgattctagataaggcaaccagtgtggtgagggctctgacaacaagggcacataagattttcaagatgttccagatcctgggaggactagcaacacagctgcaggaacttagatgtttaggttagagaagagaaacaaaagagaacaattgtcttcaacacttagaggccagtggaagagaggaaaagaaatagaatcacagatcatggaatgaagagccaattctgaatctacgcaagaggaatttaaggaattttaatccatatggcagaatgcatagtaataaaatcactataattctttagcttcccctagtgggtttcgaaatggagtaaaggtagtttgaacggaagagttcttagctgtatagaattagtctggacatagcagaacatttagcgtctctggctcccactcacaaaaatccaatactagtcctaggtcattggaataaccaaaaaagccctcactcatttacaaacgctctcagttgagaaccactgaaatttataccatgtgctaggaattgtgcatgatcgctttaatacattttttaattctctcaataaccaagcaagatagaaactgtcattcccatgttaagatgaggaaattgaaactctgctactagcagacagaccttctgaatcagattgcctgtttatatctctgatagcagagcactttaagatttatcttagattaagataaccaagactctgtattaagtttctgagatactatcggtttcattcatgagtatgttcagtggccatactattcacatttgagctcctgcttcctgagatgaatttacctcttgtagcagctttactttattgagatgatctagttttatgtcccaggtgctcctggttttctttatctcactgtagtcagccttaccatgtaccaacatgggaaaattctctccttactaaaataaaacaagtagtttaagtggagaaatgaagtaacttgccaaggataataaggcaaatgaaaccggagtaaaatccatgccagtactaaattcaataatacattgaggataaagggagtcagattgtagttctgtgaaaggaaaatatctataaattatatataaacatatcttagaaagatgtcttacttttgattgctaaatagtgctcatagaaatctggtattttgttgacacaaatacaattacatggtattctgctatgacaataatgctaaatcctaattcattaagcaagagagagtgaaaggcaacataatacaatggttaaatatttatgaactggcttaggctgtataagtttgaattccagcttgacaatttattaatttcacgactttcggtatgttattcaaccttacatacctcagtttcctccttgtaaaatagagtaattgtagtatctacttcataaggtgagaattaaatacgttagtacataaaaagtgcttagaatatttttgggaacagtaaaaatattaagtattattattattaaggagcttatatttccaacttgctatctcaggaaagtccttttatttctctggcttgctttcttcatcactaacaatggtttgcatgaaaagccagtccagaaattctagatgtataactgcaaatttatcacaatttttttatctccacaatttttcactggatacatctcactgatgtaacaaaataaggatatcaatcatcagttgtacatatcctcttgaatattacataacttttgttttctctcactattttgttgaaacccaagcagcagttatttttgtctgttccttgaattagtaggttctgttaacaccttataattgttcatagttcagttttgtagctgctcacccaaagaacataaagtgcagactggctattacaaattttgtttgcttaatgagaaggggaaaggataaaatgtttgcaggtacatcatgttcagagttttggaatattcaatttgcttatcttctgagagacttgctcatgtaatatctatgttttatgtcttaatctaagacagccttctctgcaaaatccacactcaaattgctgcattttatcctgtcagctgcgtctttgggatcttgtctaataaaacatacaagtgtctttttctcctcctattcattatcactaaaagcatttcagtgtctcatttggtgaaaacaggcgtctactcaatttgtgaaatgatagggtatctatgttttaagtcatgcttgtcagccacctgattttccactagagttaggaaagtttaactcacaatgctgctttaataaatcagctcaatgaattattccattcagcataaaataatagctttgctgtaaagaagaaattcatatgtaattatttaataaattcaataaaatttttctggaaattactggtcattcgttaattaaaagttaattatgtttctattgtattccaaatactgtactgggaatgaatttttctagaaaattaataaaacatggctcctgcccttgaagggatcatagtctgatgagagagagtaaaagaattctaaaataaaaatcacctttttaaagattctaagtataaagtcggaaggggcagaatcagatttgccttagagaaagactatttgggggaagggcgtgtgtgtgtgtgagtgtgtgtgtgtgtgtgtgtgtgtgtttgaaaggagacagagacagagaaatgtgaaatgtagaggcaaaaaactcacacaagaagctctcatgtgaaatgaaggaagcctaaattacggcagtgacattggagacaaagatgtgtagtatagattgtagagctgctagaaaatatattcaataagactgaagacaaattagatggggaaaattctcaaggatgacttataaggttgctaaaccaagagactgagtggatgatggtgccattgaggcaactggatatatggggcaaaagctcaggaaaggtattggggcccggtatagaaacgtcagaggcagtaataatttagggaaagtgaaagcctctggggtgggtgacattattcccagaagaatgtttaaagtaaaggaggaaagaaaaaaaaaaaaaaaagaaacatcaatttttgagaaatttgcaagacagaggaaactagagactgagaatgaaagaatgaaaagttaataagaaccagaaatttcctttagcatttcatttaggggtcaagcctatgatgaagaatttatataaatatcattcatttaacaatattttaaaatgcaaaaagacgggctgggtgcagtggctcagctgggtgcagtggatcacacctgtaatcccagcactttgtgaggccaaggcaagcagatcacttgaggtcaaggagtttgagactagcctggccaatatggcaaaaccttgtctctactaaaaatacaaaaattagccaggcgtgctagcacgtgcacccgtactcccagttatttgaggggctgaggtgggagtattgcttgagcctgggaggcagaggttgcagtgagctgagatcgcaccactgtactccagcctagctgacagagagactctatctcaaattaaataaataaataaataaagcttaaagacaaatgaaaatctgaagcaaatatttgaacttttgtaacatataaaagttagcattcttttttttttttttttttgagatggagtctcgctctgtcacccaggctggagtgcagtggcacaatcttggctcactgcaacctccacctcctgggttcaagcgattctcttgcctcagcctcccgaggagttgggactacaggcgcctgccaccacgcctggctaatttttgtatttttagtagagacggggtttcaccgtattcgccaacattttttaaactttcacccaaattaatattttatatacaaaaatgaaatgatgaaaatctttaaaatggtagaataagaacctccaagaatcttctcataaaacacagcaaaatcgtcataattaactttttcaaaactctagaaattaatcaaagacttgcatcaaaatctggggagtgtgtgttctagaaaaacggttgaatttcagtaagaacagcaaattttatggtatatgaacttttcctattcccatcccctcccttcatccccagttctgtggcggccttgaaaacaaacaattcacttcgctggtgagaatcagtagcctggcagccaccaaaggggaaggatggggctaaagttccctcaaagccccattcctcaagaactattattgtttgacttgtctggtggttcttgggaagacttatctttcatattctctttatttgacacgatttgaaatattcgaatctttcatattcaaatattctccttatttgacatgatttgaaatgtcagcccacgtgaacagtgtcttcccctaggtataccatctttgttgattgaggtggtaaataagttagggcaaaaaaaaggcaatccaaaaagcttgtaaataaaagtttggaaataatatatttaaactgctaaaattaatttaaaaactgccacataatcgaaacgtggcaaaactatccttcaaaaaatgaagcagaaatgacattctcaggaaaagaaaaagtgagacaattggttgctagccctacagcaaataccaaggggcaatttccaggctgaaataaaaggacataagacagtaacttgaattcagatgaagaaataaagagcaccagtaaaagttaactacataagtaaatataatacacagtatagctatatttttgtttgtaactaattttctttgtgttttaaaacaagtacataaagtgataactaccaattcgtgttgacgggcatgcacaaaggactgggggaaaatgaatctatagaggagcaaagttttgtgctctactataattaagttgctattaatttgaattaaatttccataatttaatgtgttaattgtaatttccaaggcaaccactataaacataactctgaaaatatagtaaaagaaaattataacagtacactagaaaatacatatttaatacaaaaaagcaaagtaaaatggaggaatggaggagcacaaaatatgtaagacatagaaaacaaatatcaaattggtagacgtatattctgccttatcagtattcacatgaaatgtaaatgggttaaacactccaattaaaaggcaaaaatcgactaatggatttttaaaaataatacaacatgctgtttataaaagagacatatacattcaaagataccaatagaatgaaagtaaaaggatagaaaaagaaataccatgcaaacagagccccagaacacatgaggaaaaactgacagtattgaaagaacaaatagaaatttcaacaataccagttggaggctttaatacctcatgtctaataaataatagaacaactaaacagaagagaaacaaggaaatagaagacttgaacaacactataagccaactacacctaatagatatttatagaacactccatctaaaaattgcagattgtacattcttcccaaattcacatgaaacattctccagaataaaccatatgttaggcagtgaaaaagcctcaattaacttaaaaggatttaaataatataaagtacgtcctccatctatgatggaattaaattagaaatcaataacagaagaaacattgggaaattcacaaatatgtggaaatttaaaacaatcgtaaattgccagttggacaagaataaatatcaagagacattagaaaatattttgagatatattaaagcaaaaatacaacataccagaatttatgggatgcacctaaagcagttcttaaagggacagccataactgtaaatgcttatgttagaaaacaaatgagatctcatatcaataacagaagattttatcttagggtacagtgtatactgctcaggtgatggatgtaccaaaatctcagaaatcaccacgaaagaacttattcatgtaaccaaacaccacctgtttcccaaaaatctactgaaataaaataaaacaaaaaacacatccaaattttttaaaaaacaagttagcaaaagaagagcaaactaaacccaaatcaagaaaataataataattaaactagaaataaatgataaaagaggataaaaaacctacagataaaagtcaacaaaaccaaaaattagtcctttgaaaagataacaaaattgacaaatttctagttagactggccaacaacaaaaaagagagaattctcaaattaccaaaatcaggaatgaaagcatggacattactattgacttaacagaaaatgtttaaatattataaggaatagtatgaacaactacatgccaacaaattaggtaacctatacgaaacagacaattcctagaaactagctacactcagggagcaacaggcaaatgaataaagctataacaagtgaagagactgaattaataaataattactgacaaagaaaatctcaggatcagataaatttactgctcaattctgccaaatattcaaaaaattaatactaattcttcacaaaagaattccaaaaaagaaaagaggacaaaaaacttccaacttatttcttgaggtcagcattacattgacactaaaactaaagacaccatgaaaaaagaaaactacagataaacatcctttaaaatataagtacaaaaaccatcaacaaaatattagcaaactgtttccagaaacacacaaaaagcttatactatgaccaagtgggatttcattccaggaaggcaagaccgtttcaacatatgaaactcaatcgatcccataaactatatgaatagaataatgaaccaaaaccacatgatcatcataataggcacagaaaataatccaacgctcttttattattaaccaaaaaaaaaaaaagcagtctaggaatagaagactactttctcaatctgataaatggtatctacaaaaacctcacaactgagaacatacttaatggtgaacactgaaagtctttccctaagatcaggaacctgacaagaatgtctactctcatcactttgacttaacattgtgctggaattctaactggggtaattagacaagaaaaataaataaaagtagtctttggaaaataactgaagttatctttactttaaaatgaaataattttgcatataggaaatcctaaggaatacagacaaactatttatgataataaattctgcaaggttgcaggatgtaagatcaatatgtgaaaatcatctctatatctatacacttgaacagtctgaatatgaaattaaaattccacgtacaatggcataaaaagtaaaatagaaacaaatttaacaaaggaagttcaagacttgcatactgcctacaaaacatcactgaaataacctgaagaagttttaaataaatggaaagacattctggggaatggattggaagaattaatattctcatgatgtcaacaatatccaaattggtcacaaatttaatgcagtccctttcaaaattccagctgtgttttgtgggtttttttcagaaattggcaagttgatcataatattcatatggaaaagcaagggactcggaatactcaagacaatcatagaaaaaagttaggctcaccatcgtaatcccagcactttgggaggccaaggtaggcggatcacttgaggccaggagtttgagaccagcctggccaacatggcgaaaccccatctctactaaaaacacaaaaattagcagggcatggtagtgcgtgcctgtaatcccagctactcaggaggctgaggcatgagactctcttgagccacggaggcagaggttgcaatgagctgagatcgcaccatcgcactccagagcctgggcaacagagggaaactcttgtcttaaaaaaaaaaaaaaaaaaaaaaaggttggagtagtattggcataatggatcaaatagatcaatagaatagactggagagtccaaaaataaacccatacatctttggtcaattgatatttagaagagtaccaagataattcaaatgtgaaaaatattattttcaacaaatgggtctgggacaactggatatccacatgcaaaagaatgatgttggatctctatcttaccccatatacaaaatctaacttaaaacgaatcaaagatctaaaggtaactagtgaaattataaaatatttataagaaaacattaagtataaatttcttggctttggattagtcaatagtttcttaggtatgacatcaaaagtacgagcagcgaaaaataaataggtatactggacttcatcaaaatgaagcacttttcaaaatgtgcttcaaagaacccaatcaagaaattgaaaaaaacacacaaaatggaagaaaaaatatttgcatgtcatatatctgataagggtctagtatacaaaatatataaagcaatattacaactcaactatttaaaagaataacccaattaaaatacaggcaaaggatttgactaaacatttttctagacatacaaatggtcaatacaaacagatactcagtatcaattgtcattagagaaacacaaatgaaaaccacaatgacatatcatttcacaaccactaatatgactataatttaaaacacagaaataaaaagggttggccaggatgtggaaaatgggaaaccttgcacatcactgatgggaatgtaaaattgtgcagccactggggaaaacagtctggcaattcctcaaaatgttattcatatagttaccagctcatccagcaattctattcctaggtatgtaccaaagagaactgaaaatgagttcacacaaaaacttgtacataaatgttcagagcagcattagtgataatagcaaaaaaaaaaaaaagtggaaacaacccaaatgtctttaattgatgagtgaattaaaaattacagcatattcatacaatataatattattccatcataaaaatggaatgaaataatgatttctgctacacatcatggataaactttgaaaacattacgctaaatgaaagaagctggtcacaaaagctatgttttctatttacagaaatgcccagaataggcaaacctataaagtacagaaagtggattagtggctgctgggggtgagggtaagaaattgaagtgactggtaacgattaaagggtttttttttgaggtgacgaaaatatactagtattagataatgatcatagctgcacaattttgtgaatatattaaaaactactgaattatacaatttaatgtgatgaattttatggtatatgaattacagctcaagtaaaaataaatgacaagcatgtacacatacacagatatatacatatgtcatggacattatgaggtgcttaataaatatttgctgaatggctgaaaagactgagagaaaagtatatggtaacatactccaaaaaggaagtgaaagtaaaaaaaaaaaaaaaaaattgtccatgttagttgtatattggtgacgggatcatgagtggtttctactttctatggtatggtttcctatttcaaattttttaattacttctacaatcagaaaaaatcataatctgtggttaaaatttataaaactagtttataacttctgattatgaccaaaataaggttaatttatatacaaaaagtcttctagaaataataagtcttaaaaataaaaatgcaaatattggacaaaagctccctctggtatatacaaaagtgttagtcttccttacaaaacacccctttatattttgcctcagttccatcatcattaacttattagtcagtctccatccactacaacatgttttaaaatattatcagcatacgtgatttcttagagagatttaattatggatatacctgaagcaaatttaaacctgtgtacatatgtgtactcatatccatagacaacaatacacaaacatctaagtctattcatgcacatagtttccttgtaaattttgtgattatgacgtatttgaaaaaaattgtaattagatatgcttgacattttaaagcaaagaaagatatagatttgacagtttaaccaatttgaaaacccagaagcccatacaaggtatggtatgtcaaattatttccaaatgtataatgctttgccagcaggtcccttgtctttatgggcatattctggctataaatatctcagtgagtataacagtttggacaacggagatcaatataaaacaagcagtggaatttaataggagttgatgtgaaaaaagtggtaggaaagatataaactgaggaatccaggtattcaagaattcaccacagctgaaaattcacaggggaatcaatttgcaataatagaaaaccagcagcaacctaacccactgatctttattacatacaaaagagcactatccattttcaacagggttgttttgagtcataagagcaaatgattcctaaatgtttagcattatttctagagacaggaatgacaccatgttgtcacctctttgaagattcctcatgaacttatacagggttaattgcttcttcttttctgtgaacactcagtctgctagtatgcgcttttatcatcgtatttattaagtctttgcaacggtttccacaccatttgctctagtcaaccaaagcaccttcaagacagacacaagaatttatttagctctagatccacagcactggagcacacagaagttgctaaacaagttgtggctgaacaaataaatgagcagagtatttgtttctgtaatttaaattttgtcctgaatattttttgaagcacactgtttaaattttccatactatgtaattaacaacatcattattaatatattattgtttacattatataaagtatataattatgttatataaaattacatatattatatgtaaaatttatgcataaatattacgtttatatttatgtcaatatataatatataaagtatgtaatatgtttatattatatattttagcaatataaataattatagcatcatgctttggcctagcataaatggtgattctacggatgacaaatatttaatatataagatgtcatttccttgttccatgaccacggcaagcattgttaatcgatcatggcattcttaactggagttagaacgggccttcagaatcctcatcacagtgtcccagggagccgctactgatcaatcaggattggcacaagagttgtgactaaccactattcctgattttctggatactttcagaggaatattttctttggaaacccattaattttcaatatttacaagtacaattaatgaagcacacccattctcctatacatattatcagctttctaaaactctgttataccacttatgtgtcctagaattctgcaatgccatgtgaaataaagttctggcgacacttccagtaacctgtaattaaacactttcaatagtagactattatcagtcttcactatttttaacgaaagggcacagatcctattaaagaaagttactgcttttacttcttatggagagaaagggaaagagaacaaacaaatacttgtggataaggattcttgaactatccctctgctagtaagacctgccaggaatgaaactgctactttggctgggcagagcaggtgctgctgattgattcagtaagtaaggaacctttacatttttttaggtgtaagattatcttcttcctgctgctctgaaacatctgatccacaggccagcacaaagaaagctatgttttttaattgaggaagtaacagacagaacaagaaaggctctatggtacggcatactgagaagacaactacaattaccaccctgcaaagctgggatttgtgagtcctggcagggggcctgcaacaattctggtagtagcacagtcccagaccagtctctcagagcctccaactaatgcagaactgtgtttaggagtctggaaaatccatatattaacagcttgtccacattcctagctggtggtgagaactgagcagtgactctgagagaatgccaatggtagacattaactcaagctggtttctttagaaagtaaaacaaaacctgaaattctttaaaattttatttgttcataaattccatgtcatcaccaagacaaaattctgaatgcaaaatccttttgttattaatttcctaactcaaacagatgttttatgtgaattaaaaaaaaatttcttaaacaattatttcctatttactaactgtggaagcagccattcttcttctacaaggaggatgaatgtagagttgtgatgggctagtggtcaggcagctggaggctggagcagggagacactgagcataggaatgtctgagcaggatgcaaggcagtgaggagagtcggaaacatcagctgctgttattagaatcatggccaatgcatccagttttttcttaattagtttatcatactaagtattaaaaataacaataataacaatagttaatgtttattgagtgagttttgtgctagacactgcgctggacactttatatgctttatcccaattgattctcaaattgaatttaggaagtagatattattacctaaatttatggatcaaaatagcaaggcttaggacaggctaactgacagactcaatgacacactgctaataaccagaggggccagaatcaaacctaagcatacaccatccacgggtaaaatattggagagttaccatattccctccaagggtcttaaagctcagattgaattcaaatttatgtaacagatagaaagggaaaagaaaggaaaaaatgtgaatgttctttcatttgtctcaaagaaagaagaaccctataaatatgccatactcttttttttttttcctagagagtgggccagagtccatttcttaatggttaagaaatgtcatgttaaagaaactatgtatggggttctattcagcatgtctttgctcaactttaggtgtttcaattcatgagagggtttgagagtatataagaaaatggcacagtggcctgtgtcggctaagactgtactttgtcattccagtgcactaatctgtgatatagcagctagaaacttataaaacattcaagcaaagccatgtgctgattcaagtcacggactaggatacagctaagcattttagcctctgttattgaagcaataagtacacaggtgactgaatgatggctatctcagaaggatttcctggaattggtcattcaaatctctactcatttaaaagaaagcacttctttacaggaaaccctggtaggctgaaatggttaagtatgatacccaaaatgaataggtaaggaaataggtaccttgaacatgatttgaggggaatatgaggcttactgttcagaaaagattaaagatctatataatccaagcataaaattaataaaatgaccttttcttttaaattgtggatggaacttccatttgtttcttcaaaagcagacagtatgtgggaaacatcagacaaacccaaattgaaagacgttctataaaatacctaaccagtactcttcaaaaccatcaaggtcatcaaaaacaaggacagcctgagaagtcatcgccgtctaaagaacctaaggagacgtggtgactaaatcccataacgggatcctgggacagaaaaggggcattaggtaaagactaagaaaatccaaatgaagtgtggagtttggttaacattaatgtgctaatgccagtttcttaattttgacaaatttaccatagttatatcagatgttaacaataggggaaactgggtgaaatgtatacaagaactctttgtaagattcctgcaacttttctgtaaatctaaattttcaaaaaaaaaaaattatttagaaaaacaaattacacacacactcacacacaggccagagtgtgcccttacaaatggccacatattaaaagcacattcataagcacttagaacaatgcttgacatatagtgtaaaatagcatatattttttaaaaatacatatatattttaagatatatatatttatataaatgacaatatatattatataaataaaaatgtatatatacatatatatatatattttttttttgagatggagtcgtgctctgtcgcccaggctggagtgtggtggtgcaatctcagctcactgcaacctcctccttccgggttcaagcaattctcctgcctcagcctcccaagtagctgggattatagctgtgcgccaccacacccggctaattttggtatttttagtagagatggagttttgctttatgttggccaggctggtctcgaactcctgacctcaagtgatctacccgcctcagcctcccaaagtgctgagactataggcatgaaccaccgcacctagccttttgaatgaatgaataaatgaatgaattaaatcactttccgtagttaaaaacaaaagtcttcaattgttcctttttatcttaaacctacactcagcctcatttaagatcttccacaagctagccaaacttttttttctacaggtcatcagaacactgcctctgttcgggtcaaagaagtcatctcactgtcccaggattgtggagccctcatttctggcttcgctttgtcatcccttaccccaaagccaaaatgctctcccaaatcattctgcctgttccagattgaattcaagctccccaggccctaagaattgtttcaaaacactcctgtattctcctgaaatcttccttctctgaattcctactgtctacttttttagttcaacatgtatatataaaattgcttatagtggtcaacctaattccttcttatccaagtgtcatttagaatggatttttaggggaggagtgaaaggaactttcatttgctccttcaaaaggaaggggttacaaaagggcactaggaaaatttaggggtgttcagtatgtttcttgatggtgttgtcagttctttttgatagacatatgtcaatcttacgaaaattgtacccatttagtatgtgcaatttaccctgtgtcaatggtagagcaataaacctgctaaacatgtctatgtaattgaatgtttggtttgtttgtgtttttttatttgtttacgacatggtcttgccctgtcgcccaggctagagtgcagtggtaggatcacagttcactgcagcctcaacctcccaagctcaagtgatcctttcacttcagcctcctgagtagctgggactacaggctcacaccatcacgtctggctaatttgtgtattttaatagggatgggggtttgccatgttgcccagcctagaatgtttgttttctaatttattatttatttacacatttatttattataattactgtaagataatagagatttgtgttattttctgaggtttaagccaaaagtaagctccaaacaaatttaatgtttgaactattacatgagtacttgagaaatagtatgagtattctctgattttaagtagtttgagatatatattttagctcattaatctactaaaaactgaaaaactgtctctcactgtgattgtatcctggtaacttcaaagtgattgcagttttagaaaatgaacacattagatcactgcttacggtataatgccaattatatgtcatggagtagtcattttatctggcttttcacagaaacctaaataaacttaacctaaacccttcaaccactttccaattactgtcccactcccagcctccagcctggctctttcatctggagacagtgacatgacttgtgtggctgtactgtaccaagttacttatgattttccaaaaattgactatatctttactgaacatttctccttgaccagcacctgcagcatcaaccttggctatggagaactggtgcataagagaccacaacctcagaatgaaggtggcacaggctccagctgcaggctatctactagtctcagtctccttggccagctttctatccacgtccatcccgcattcagaagccccctttcttttcctccactgctgacttgtgttcttttgcaatttttactccttttgttttaacttgtcctgctggctatgatgctgcttcatcaaacaccaaatcagctccaccttcttgccctcctttaccatacttacctcccatattagacatgtttattaatttgcttgctttctctcatgccctgcacaatctcttccactcaaatcattaacaatgatactttcaatttctgattttgccttaccaaacactctacttcttcatattcagcttccctttatacccagcacatagtaatattgtcctgctatgcaatatagtggaaaaagtctcgtaattggaaaccagagtctgtttgagtcatggttctgtcactgactcaaccatgactagttatattatctggaataactcactaaacctcactaagatccagtttcctcatatttcaaatggcattgtgagagttacataaaaatgatgcaggtaaaatacaaactacaaaatgctacatggatgcaagatattgcaaacaggcaatgtgtatttattcccaatacaggtgtatgtctttgagctctttgaaaaattaagtaaagtattccatttctgaaagtaaaagctataaaacctttctaaaagtctcacagtaacttggtagacataaaagtggagaaagaaattgcctttctgaatactagagctttgtaagagatgaaaccgagatgatataaaacacaggctgacttcaaaatggagaagtgggtaaaattgaggtactaatcaaaatgtttgaagcctgtcatccttataagaataatgccatgcttaagagccatgtgttcaacatctgcaaagcaaaagcaaatgaaaaattctattagcttgtaccagaaatgtgaacactcagctgaaactaacactattgtgaggggtataattcaaaggaatatcaagatggaaatgatgagtgaggagaaaaggtaaaaattattacataaacacaatttattttggaaaagcacgtgagcatatgcaaggcagcaaaatctagactatctcctggtaactgaatagcagactcagcatagggtttcagaagaaaaatcagaagccagactaaaccaaactagttttttctgtgaaatctttcctaattcccctaggccaacttaagtactttattctttatgctccaattgccccttgcacttacctccatggtaactattaccacaatgtattataaccatctgtgtacgtggcaatttcccttaaactgttctacttgaaaagcagaaaccattcttttttcctttgcttccccagtgcccagtatgttgcttgccacgtggttattaagaaattgttggtaaatgatgaaggaaccacattttggccaatggtatatctaatgatgaatatcagcttcttctgaggacagcaaataaagatacacttattttaaaacgcttaagtgttagtgtattgcttatggaaacagcttcatcattttattaaaacccaactattttttactgcactattccagacaaattattagggacctaccacttggagagtcatagtctgcccaagataattcacaagattgatttctgattctagtgaaaccagagttacagggtcagcccccatacaggtcagacagagcagccacagagggcttgccagattgcatactatgactgcacagctgtatggaggtgccattcacgtagagtaaatgtgaagaggcatgtaatgcaatacacacaacccacatgacagccaggtagcttgttgacaaaataaacctgcctattttgcatccaaagtatttatctgtgttccctcagtaattccacaaaggtgtgtctttgcttaaacaataaaggaaggatatccttgggccactccatgtcaatagctagaaaaaatgtctctggtacaacaccttgtaaactccctttatggaaagcaagttctaagggctgttaatagatactccagtaaaagtggttcagggccaaatgagtcagaggaacacaggaataaagtttaactctttctttcatgtaggatatcttagaatttgtaatatgcgaatacattaatctataaaagacattataggctgggtgcggtggctcatacctgtaatgccagcactttgggaggctgaggtgggcagatcactttaggtcaggagtgagaccagcctgaccaacatggcaaaaccccatctctctttactaaaagtacaaaaattagccggccatggtggcacacacctgtaatcccagctactgtggaggctgaggcacaagaattgcttaaacccgggaggcagaggttgcagggagccaaggtcacaccactgcacttcagcctgggtgatggagtgagactctgtctcaaaaaaaaaaaagacattatattatacagtgtttctcaaatatattttacctctaaacactttttcaattaacattttggaaaaaaaaaaaaaaggactagtgcaatttcatgaaccacactttgggaaacactgccttagactacagcacccattcctattagccttacaccaccacctactgatcagaaactatgaggataggccagggaggtgtatttttaacaagctccccaggggatttgttgttgttgttgttgttgttgttgttgagacggagtctagctctgtcccccaggctggagtgcagtggtgcgatctcggctccctgcaagctccgcctcccgggttcacgccattctcctgcctcagcctccagagtagctgggaccacaggcgccctcccacaggggatttttatgtgaccaaatgggcactactagtggacccaagtttggaaaccactctatgtgttaacctcatgtctcaccactaaagatttccattctcaaaggttaagtttctctggcttatatttcacagacctcaaaatctctcatgtctataagcaggtatgcaagatagaaaaacagcctgatttctaataccagattaatacttttgtagtttctgatttacgatactgttagcaaagcttctcacttgttgaatctagaatttaaatatgtgtaccaataaggattaaaacagtattaagatatttaaaatgcaaacaaatacctgaaggtttttctttcctagagttttcttacaggagcactcatagaatcttagaagattagaattgaaagaagtaccgacagaggttaagttatttacctgtagtcccagagctcattactagcaaaactggggtttaaattcagagctcccactctgcttctactcgtgctccttcttcagcataaaccaatgcagcatggagaattctattctaaacacctcaacccctcacaactactaatttctctttttttttttgtttttcctttttgagacggagtctagctctgttgcccaggctggagtgcagtggtgcgatctcggctcaccgcaagctccgcctcctgggttcccgccattctcctgcctcagcctcccgagtagctgggactacaggcgcccgccatcacgcccggctaattttttgtatttttagtagagacagggtttcaccgtgttagccaggatggtctctatctcctgacctcgtgatccgcctgcctcggcctcccaaagtgctgggattacaggcgtgagccaccgcgcctggcctactaatttcttctttaagcaacctttatgtcctcaaaaagtcataaaaaagggaaaaaaaagaatttttgttttatatgtttttaaatgacagctttaaagacagttacctgaaaatgaaacaaagaatgattccaaagctttactcccatgaaatagcctcttcaatactcccctgatccaatgcatcaccatcatcctctttcacctggactactacaataatcaatcttatgtccttccaaataagtctctaatctgcaggaaaaacaatggtctttttaaaatgaaaacctgatcatgttattttatttctttaaactccccagtgattctctgatgctctttggatccataagcagtaaggcctttgtaagcttgtgatccttcaatcccatttctggcccatcttcccttgtgtgccaggcttcactcgttctgacttttcaaatttcttaattgtgctatgctttttcccatctcaagactttaccatacgcttgctctctgtctagaacatttcctatgcccaatccaagctttcactccactaacttttaatccacccttacctctcaggtttgaaatcttttctgggatgctttctctggctttcattactgagctgtctctctaccagttggcacttcaattgtttactggtttgattcctctcctagactataagcaccatgaaagcagcggatattttactagacagtaaatcctcagcctacctagcacacagtagcaattcaataaagagttgtgcagagaagaaacaaaaaaaaggggaaggagcatgagatgcaggaaagcagaggagagaggaaagggaaagagggaagaagggagagaagcatgaaaacaatccactatttttccagcacaatgtctttaatatgatgaattctcttttatctgatatcttcagggatgagatattctgattaattcattcaatttaagacatagttcaagctttcaaaaactaatgaggataaggcaagcagattaaagaagacaaggaattcaattgtatggaatatagagcaaatcctttatcaacaaatagcataaggaaaggaatgaatttggtcaggtgctctgaaacactgaacaaaatacctacgtacacagccactcatcctgaaaaacccagcacattctaacacccagaagcactgcaaaccactaagtaattcactgctcaattaaagttcatatcaaagacataatatttctataagttgggaagaaactacactcattttggcagaaaaaatgactctatagttttgatgataaattgttattcttacaaagagaggtctgagaccctgtatatatctataagcagtagacagggccttaatttttgaaagtctcatgtagatatctaagatcacgcactgtaaaagcacacacagctcaatttatctgtcttagaaggaaagtgagccagatggaccctgctgggatttgtacctgaaagttacgggaaaatttgaagttccggaaaaagttcttaaggcacaccagttaagaaaaataagttgaaaaatatattgtttttgaggaggccatttactaagccaacaaaattaaattaatgccacaatcactgagaaaataaaaagatatacacgttataattttagttctcaattattctcctgtaatcagtttgtcttcctactagttgtggatatatcaattttcaaaaaaaaaaaaggaagaagaaaaggtttttttatgacccaactcaaagtcacagattcttctagctagtagcaatccagaaataactcagcctaaacttctcattttaaaggtcagaaaaactgaagctaagagacattaaatgaccctagcaaggtgacaccgtgagacattggcagagtgaggaccagagctctaatcccctaactcagtagctagatttctgagcactagatcactggaggaagcagccatatttttctattcagaaattttttttcttcaaagcaaatgcatcacattctatttgagcttgtagacacctaaaaaccccagatggtctcatatcaacttcctccaaggcagttcacccccttcctgaatttgtgcgatagattatttttactctaaaagaagaattttatttatatccatgttatattttatcttggtgctttcagatcattgtttctgccttttaagatcaaattgaattttggatctgccattcatgttgctaggtagtcctctgaggtctgaatcattgaagaatctaaagagcatgacttgtgtgtcttcattcaggtcacagtgaggacactgaatagggagagcagagctgctgctagccagtctgccaggaggcttaatgcatgaatcaagacctacttcattgactgttcagtaggcattgaatccacctaaagattttttcatccaatccacatttttctatcttgtttatatctctataataagcataattgcactgactacgtgcaaatccttatagaataagcatttaaaaacaaaatattacatttctaggaggttttttagttgacaaagtattttatgcacattatttcatctgaaactcagagaaagtaaacaagtcagggtttattatttctgttttgtagattaggaaactaagtttcagagaagttcattgacttactcaccatcaacaagctaatacgtattgaagtagtgtgttcctagacacttgctccaacacttttatgttatttcatctggatagtgtaggtagctgtcaaatacatgactgagatgagtttcagtactgtactacaaaatctcaagtgaactacatatccaattttctgaacaccaagagagcccaacagggagagaaaggctcctcttccatgtgttttctcaagatggactaataggatttcacgaatcctgtttcaagtattgtaaacacacacacacaccagcttgctatttttctattttgaatacctaagaagcttttacccatcccgccctttgtcccagtaagtaggcctttactgtcaagaaaaagagcctagttgtcttgccaaaatgttattgggaaggtaccttatcaaagaccaacaatagggtgtattgttcccatgttctttcaatgacacactcagctccttggtatgtctccctggttcctagatagagaatgccaatacaggttttaagggctgcagccaatcccccacttttcctgccttctacagttgagctaatagccagcttttgtacctattatgtgtactcacatacaattgtcaggttagctattaagtagataatcagatgctgttttgagtgttggctttcacagatctataaaagacaccctgctacacacatacatgtgcaagatattacgtcctaagggtccactgtgtatcctgactgtgctgagtattacaaggggcattaacaataacacttcacagttacacaggattttagaattgacaaaatactttcatagatatcattgtgatcctcacaatagttatatgaaataaacagtacagatgccatcatttccattttatagatgagaaaagtgagatacagcaaattcagtgacctacccaaggttacacaactattgagtcactgagtggtcttaatctaaaatctctgcaatccaatttagcggagaacacaagttatttgaagatatgactttaagaaatgaaacagtcaacagcatgaaccactcatattcaaatgctgcattctaagcgttcatgaaaaaagttgtagatttcccgattgagctcaacaaggcatgcaaggcctgctagagctctcgtgaaaatcttttaaatcttttcaccctagaccacagttcaaaccactaaacactttaaactgtgcttttcatgcactagaaagagctcttattctgttgtggagagtacaataagacaaagatgcaactcaggtgcattaagttatcctattcaaagaaaataagtaaattctattcaaagaaaaggggaaacaccctgttcaacctggtgaattatctgatggcagttaaaggtatgaatcataaggccatagacactgcagtgaggaagcatctgagtttcatctgacacaatagcaaagtactaagcctgtaaaaacttagtaagacaaggaagacaaatgacaaagtgcagtatgactctgaataatttcttgacagtaaatggagggctcagcagtttcctgcacattaaaaatcatgccctatatgatgtgacctgtaccctccttaaagaaaaattacagtcaagataaatgtaataagagagaacaaaaagctgagaagctgaattcacaccaaagcagataattcaaaagatgttctagagcaatgtcttcaagggtggcgcctggaccagcagcatgatcatcacctgggaacttgtttagaaatgcaaattctcaggccccagtcagacccaaggaatgggaaactttaggcctggggcccagcaatcaatagtttagcaaaccctctaggggattctgactcttaggccagctaaaaatatagtagtcctgttatcatatttactgatatcacttgccctttggcagtgccttcagatgaagaaagttaatactggatgatgaatggtgtgtttccatctgctatgaaccctggaagtgatacttttgacacacccccaccaccacccactgtgggtgctataattagcaatctgtggaggaagtatctctgaaagcttaataagtacaatgggacaggtatgaggtaattaatcattcaattatggtcatgatacagttaattaaacatagtttctcctccctcaatcacctagctctttcttagagcagtgattatcatattttagcatacatcaaattcacctaggagggagggcttgttaaaggggaatcctgagacccaccccaagagggtgatttagtaggctagcgggtggggccagataatttgcatttctaacaagctcctaggtgatgctgatactgctgatctaaggaccacattttgacaacacctgtactagagaaaaaaaaaacaattaaattaattttttaggtactggaccactggtgtgctggtgaatgtttaataactggctttccaggaagaaaacaaaaagtagtcaatgatttgtagcatttgccaattctgtagcaaatatttcaaccatgatctatattaagctacaacatgatgtcactgagctgagagttaggtagaggtgtacacagtccatgtttgctagccagctccagtgcagctctgtagccactccacatttctctggacttgatacgtgcaaaacctgcagcatcacactgtttaaattccacagtcccctgaaagtaggaatttgctgagtcaaacagatgccccatcttaattctgcttccttgtttggtgagtcactgactctttagcaggagagtcatgtgaagatccatttctcacaataaaactcatagtaaatttccccaaatggagctccattatcctgagtatccaacactcagaacttgatttgggaatggtttcggcagcagactgtccactagaaaacgggataccataaaagtaaatggcaaaatataaaagctgtattaccaggcgagtcctgcagtggggctcctaaagtaaaatataagtgattccatctgaggaagagttcagatatcaaatgtgacaaacccactatgtggcatgtagcgaataacccagttcctttttaaatatggaatgcatgctcttagagtgaaacactcagaaattttaaataagttccaataagaaaagatgaaaggaaaaaaacagattcctctttcctttccatttgaacctctactaaactattctgcataaaattctatgtattctgtaaaaacttctgtgttgcctcggtgaaatcatgacatcttccttacccccacgtatcatttttttaatgcaattaatgctgccacaactggccaatcatccagtcttgtcagaaattctggtcagaatccttactcatacactggataactagcctttgaataatcaaaaggtgactgtaaaagtgaaatctgcttcaggtcttacttgctttgtgaaggtaaaaaaattcctgatcaatgtgcagagaaaaaaaaagtggatcagcaaaacagttgcctttaagacattctcttgccttaaatttacttatcaagagagtctccttaccttgaatcccagccagtattattatcgaataagcaacatcagaaagtttcaccactacgaacaacagaataaccatcacaagccttttggcaaaagataatgtgacactccatttgaacaacaattttctctacatactaattaaagtagttactgttgacccacattttcatctggtactaggggacaaagataacatgtccatgtatcgtttaccagcaccagatttcccaagctttcagccagccctttcaccaacttgccatcaccaagcagtgaccccttcctgaagagcttaacctacagagagttcacttggagtcattcagcacagctccgtaattccacacttgagaagtctctcttgttgttggaccacagccagaacaaaattaaagcatttcctattcaattttggcaactgcaaggacccactcacttaaagcttgataacagtgagttgattcaattgccattcaagaagaagcagttttgcaaaatgggtttcctgtcagcagcccacattaagcttccatttgttctgcctctctctttctctccttttccaaagatttaggaaaaggtatgtcccaagaacttagcttttttggtggtcccactgaggacatatagtaaccgaattccaagatatatattattatatgccatgtacataccattgcacagtcatcaaggactataaatatccctaattctctgccgccacttgtccatgtctctgtctacagattcttccatattcatagctttcaaacccacctgagttcctcctttctctcatttcaaaccccagtgacggtacaggtctaaatctgaagagtcttcattattcgtcttctccctcattcactgcatcacctagggcaataaggcatttttcaaaagaaactatcaagcaaataaggcctgagtggtttgtttatgattctaggataaaactcaaaagttgcagtcttttgtgatgcatgatttaatagaataggaagcaggccaagaaccacagactagggagagggagtgagaccattaatcaattacagaggagcactcacaacagtggatatcatagaaagccatgttttccacagttcagaacacactgaggtaatgttagatgattcatgtataaacaattttgcttcagtaattatgtgtttagaacctacaacaataataaatgttatctattattagtactactgttacattattttgtcttctagaagctaattctttaagaaaactattagtgctttgatgataaataggttttaatgtacttgacaattctgaaagataaatagtggatgcctgaagagctatgttggggaagatggtgaagccacgtctaaattcagcaaataaataaataaataaaatgccttcatcagttagagataactatcataggcttggacagcatatgtataatacatttgcccacctgcccccaggactagcctttacggttctctaggagaggaaatgtgctgagctgctgtgttttacactgctgtattatcaattcctggtgcatagaacctacttaatacatttttgttacattgaatgcattgatgtagaagcactaagacttcgctgaataaacactgagcaaaatgcaagtctgtattctggaaccagcaggaaaaagtaactaatctattacctcagactaatcactgaactatttcaggctggtgcttataagaagttggacaggatgatctctaagtccttgggtagccccaaagcctatcactatttcattctcccttctgtttctctttggcgaagacttttgtaccctatgttatcgatgtatgccaatacattcatacttataaaaaaaaaaacagaatcaagagtaagttctgaaagaacagagaagtttgatatttaaaatagttgaaagttgtgaaagtatcaaatagaatggtctgtgataatgccaaagggccacagaaggttttaaatgagtggctgaaccttggtttgctttttagagctgagcctttcaaatctgattctctttattctgtgacatttgtcagtgaccactgctgattacctacttgatgatgtttgagctatgggtttatactggtgattggaaaggagagaaggggtagctgtcagaaatgtgaccaaagaaagatcataacctagaaaatgaaaaacaggatggcaaaaattctagttcttagctgacatatgacatgaatatgagtaccttacagagaaggcataaaagtatacagaattactaaccatgcaacctagtgaaatacaatccaataaatctcttatcaaagcaaaaagacacaaaaacttcataataataaaaatttttatctgttctatctagtctggaatccaaaatagtacttaatgtccccagaaaattatacatagacaactcttccatgatattcacacagcaaaaagtgtgaaatgtgaaagcacttaggatgaatattcagatgtcaatctcctaatatcctcaaacatctcagaaaagaacattcggaaaaacacaaactggaaaatcaaaataaagagacatatggacagaaaaagagaacaaattataacaggcagatataatccacatataaataaacacaagatcatgtttttctgtcttaataatttatacactttactccttagtgaaatccaggacttttgatgatatcagctctaaccaggaatctacactgcccattcatagttgtctgtgaaatttagatgtttgaagtatctgatttggggtggtaggtcttcacccattaattagctctggtaatgaaaatccctcaagttatctgaatttgaaagattttatgtggcttcaaaaactaatcccgaataggccaggtgatgcccacttgagaagctaaggagaattacttaaaacacattctggctgcaatattattgttcatgctgaaatgcaagaagccctcactgcccaacaaggggcaaatgatcccagatcagagtagactgactgaattagatggaatattttttcaactgttatttccttcacattatggataatgtcaggcagactctggcttacccttaacttaaggacttagatcctgcatttcttcttccaagaagccatctctctctctctctctctctctctctctctctctctctctctctctctcacacacacacacacacacacacacacacacacacacacccctcggtataggttggaagtccttcctcagtactgcatttacaccctttgcaaacctgtatcatatcacctatattttatttgctttgtattctcagcacctgatgtacctgaaactttgtaaaatcagagaaacaaaatgaaacctagtcaaggttggatgagtgaaagaagtcttgaaagtgatgtgtcatatcttttgcagaataacagtaccctattttcattcaatacatgaattcgaaattctaatttatttgctttcaatgtagaatttcccaaggtctgtatatcaaaataatagtcaaggctgttctcttttttaaaacttaagatacatcttcaatttcatatttgttctctctctctctctgtcctattttgttgcttgtttgtttccacaaaggacagaattaagacttatgaatagccaaagagaagcatggcttagcccgtgactaaccataggaactatagagtaaatcaatttcttcctcatctgtaaaatgagatgattagaataactgatctgaaaggaaggtttctttctaattttgtcattctacaatcatgtatgttacctgttctatgatatatattcaggaaaccacattaatttgaactatactgatttggaatgggtcagaatgttgactgagataatcaaacttatgttagattgctttttttccttgttttccctattaaaagaagagaagcatgaataaataaattaaccacataatgaaaaaggttgagggcacctctactctcctaagaatgcaaactggtctttaagtgctttagaagtgtctatttacttacaaacggtgtaactgcagtatatgtagggttgatactgtttaaagtattttgatgagctaattagagatcatccttatctattaattaaaactccactacacagtgtctgaggagttataatagttgcagtttttatatattcttaaagggattaaaactaaaacaagtattcatcaatttaattagctttccttccaattcattcaaatggatgattgacaatgcttatgttaaatgaacttattttggaaaaagtagctgcattaaataaattataagaatgttgatatattggtcattggtttcaaatgtcaagattacaataaaaatagcattaggtagtcaacccttatttcccagagtagagggatggctcagcaaaacagggggacttatgaattaagtctgtctatgcaaccattcatagaagtattttgttgaatcaaagcattctctatgtaatgagtgaataaagcatttcaaatcaataatcatgcactaagggctaacaagtgctaggttcataaatgggctagtataatgtatgggtaatacattttttgaaaacacaattaagcacttacacaaacaaatataaagtatactaacaactgccataaaatggatatgaaaaaatgatttatgagggtcaaaggtaggaaagactatacctctgtggcaggaaagaatttcccatgtgctactttttttcttttttcctgatacagggtctcactctgtcactaaggctggagtgcagaggctgctcactgcagcctcaacttcttggctcaagcaatcctcccaactcagtttcccaagtagttgggaccacagcacgcacaccaaacctggctaaattcgtttttctttttttctttttttttggagagatgcagtctctctatgttgcccaggctggtcttgaacctcagggctcaagcaatcctcctgcctcagcctcccaaagtgctgggattacaggtgtaagacatcatgcccagctgctactttcttaatctacacatcaacctttcaaataatatattagtattgtaatggaatatatagacacaatcagatgaaaagaattactacaaaaaggaaaaacaacgaaaggcaggaataagaaataggcatgaagaatcaggaagaaaccaatctgaaagattaactgcctcgtattgagaagtagaagagaacagaatcacatgatgaatcaatgccagtaacccaagaggaaagtaagatggggaaaattaaaattcgctgaaatctaaactggtcagtgtggttatgtagccacaaagcaagtagagaagaacttaattggttttgctgactaagggctgcaggtgggcatggtgatacataaatatatgaagtgatgtgtgattaatgaggaaggggtggtttgtaggcctaactggcagtttgaaatgtagtaggatcactgttgtgattttattctaagtataatttttgcattatagctaagggcatcagaaatttgggaaattgttatattcagggttaactcttcagaaacctagaagggaaagagaagatgacccttccatgaaagggatgaaaacactgaggttgaagagactgaattatggctccctgagcactgcctgccctaagagattttgatatggctgactcaaaccaggaagcgcttggctaaaataaggtgcaccaaaacaagacctcatgaaagaggggctagtcaaatccagagcaaagagtcacttagtgtacaggtacttctctcccagactaaacagaccaaaaggattttccagaactctctcccctagacagagacagaggttggaaaatcaataccctgtgtaagcaaaaggacgtggatgtagattggcagagaaacagaaagcaaggaatacaatacagtagctcatgaagggattgaaagagggtccaaaacctgacatcttcactttataaatgagaaaaccaagctcaggggggtttacgggctcacgatcacaggggatcagtagttcttaggattcaatcccagacccctgtcactccaaaggcaaactgcatatttctttaacaagcaggcaaagtttgagatgaacaactggaaagcatttgcatatgtgtaaaggcatccaggtataagaatcaggagcaaaagatgggacagaaaatgtgagatgtgcctgataaacaccaggggtgcactgtactttgtgaatcatcactcaaacagatgatgagattaagctatgaaatggatttctttgatgggaaagagcagacttctgaggatgtgcagaaagaatgtgaccataagggaatagaaagtcatctaggaaagagacaacagaggaacttgacagagtagggaaagcatcttgatgaggcagaatcacaaaaaccaaaggagaagagaatttgggcatgtttttcaaatgcctaacttcagaatcagaaattacttactaacagagaaggacatgacccttttatttctcattcttttcaaccatccgggtcttcaggcaatttttttcattcctttctcatttcatgaattgtttttggaacgttgatttggtgagaaagggagtgcagtatttatcagcattttcattcagaaacagaacctaaaatattctatattcactaacggaagatgaagagtaaccagtttcttttatttctttgtttgacaaataattgatgcccaatagggcatttattggagaacaataatatctctattatagctataaatgtctggatccagagagccctgttttgcctcttgtcggaaaataccaagcttgtatagctggctagtaatatttccaagtactactgtttgaatttaggcataaattcttctaattagattagatttcttctaaataagaatttactgtgtacccttagattgcactgtttaaaagaattaggcactttcttaaatccgaatgactactcttgttctttttgagtagtttatggtttttccaaataatattcattaggcagttcaattacagggtatgttctattccttggttattcttagtcaatacctgagtgaaagtagtgtatccttttcatgtttctgtttagcattagtcattatttgctaacagagtagcctattgattggtgagacttgtaaaattaatggctgggaaaacaacttaacctcatggcattctatgaaatccccagagttccttggaccttgcttgcaaattactgtctttatgtcactggtttttacatacatgtaatatttcttgtttaaatcttgggaatttggctcatgtaaaggctcttcttcactcagtgattagctagtcctttgtggaatcttcagaaagatttatattaaggagtcagtcagtaatctaagagttatgaaaaaatagtttcatgaatcaaaccatgtgtgtcagtgagaatattttcatgctgtttcttttcattacattacatgacagagttgatgatttacaatgcaatagccccctctctggtagtagaacagggactaaattgatattctctcacaaacacttgtttgcaatatttgtttaaagataaccccctactatggccctaactttttgaatggttaagtgtccttccttctaattgatatatttcatttataataaacctggtttcaaataggaagaacatgttgggtggtatagaaaggggtggaatgagaacaagtaaaggtataagataatatttacatttattttgtaggaccacaaaccatgcaagtctaaagatcacaaacaatttgtaaggaagaatacaaattataccaacaatagagaacacactttctttaggaaataagacatgaaagaggctttgagaaatgggtagactttgcactgacatggagaaataaaggatggcatactaggcaatgagaagaaagaaagaacaaaggtatgcactgaatataacctgaatcgacatttctccacagaagacataaacgtgaccaacaggtacatgaaaggggctgaacatcactagtcatcagggaaatgcacagcagatatcacctcacacctgttagaatggctattgtcaaaaaggcaaaagataccaagtgttggcaaagatatggtaatggactaaaactgatacataaaaatgtgatatataggctgggtgcggtggctcacgcccgtaatcccagcactttgggaggccgaggcaggtggatcacctgaggtcgggagttcgagaccagcctgaccaacatggagaaaccccatctctactaaaaatacaaaattagcctggcgtggtgacaggcgcctgtaatcccagctactcaggaggctgaggcaggagaatcgcttgaacccgggagggagaggttgcggtgagccgagatcgcgccattgcactccagcctgggtaacaacagcaaaactctgtctcaaaaaaaaaaaaaaaaaaaaaaaaaactaaaaaggtgagatatatatacatacacacacacacacacacacacacacatatatatgtatgtatataggtgtacacacacaataaaatattattcaaccttaggaaaggaaatcctggctgtaagcggtggctcacgtcagtaatcccagcactttgggaggccgaagctggcagattacttgagctcagaagtttgtgaccagcctggccaacatggtgaaaccctgtctctactaaaaatacacaaatttagccgggcatggtggcatgtgcctatagtcccagctactcgggaggtcaaggcaagagaatcgcttgaacccgggaggcggaggttgcagggagccgagattgtgccactgcactccagcctgggtgacagagcgagactctgtctcaaaaaaaagggaaatcctgccttttgcaacagagatgaacctggcggacattatgctaaatgaaataaaccagacccagaaacacaaatattgcatgatctcacttatacgtaaaatctaaaaagtcaaactcatagaagcagagtatagtgatggttgccaggggctaagggatgggggaaataaatgtacagttgcttatcaatgggcataaagtttcaattaagcaagataaataagttttggagatctaatgtatagcgtggtgactatagttaataataacatattgtatacttgaaatttgctaagagaacagattgtaaatgttctcaccacacacacacacacacacacacacacacaaaatgaggggatagatatgtttgattgtacaatcatttcacaatatatacatatatcaaaacatcacattatataccatatgtgtgtgtgtgtgtgtatatatatatacacaaatttcatttgtcagttatacctcagtatagctatgaaaaaaaagaaataaatttgttttcaagtgttaatactgtgactctctttttaggaatggatttctggaattttaccttgtagcttcctccaatccaaccttcagtagcctgtcagtctcaaatcaggtcatagccatttgtagtatctgtcctgaggtgataccaggaatattataaatccagttacagagccagggagtggctttgttgtagtcctggtctgaaatccctattggtaagttttcttctctcagagctagcagtttacaataagcagtagtccccactcagctttcaaaatcatgttttcccccattcacaaacaacagattcttacagcagcttttgactttgaatagtgagcttgaatctagtggtccatcttgcatgaaatattttaattccctacatccacaagggagccagtttctaggctgcttgcagaagtgtgccccactagttgatgactttggtcttgcctgacattttatgtttatgttctatttcaagtccatagagatgttatttcatttttgaaagcagcaatgagtttttgtgttttctttttatatgactctattttctatatttgaaacacagcattcttgtcatggtgtgaacttactctgccacattgtctggaagtcttttcagggctatatctatcattccaaattgacaggaagccagaaataaaattatacagaaaacatggtgaccaactatattttgaatatatagagagaatatcttaatttatgtcagtcaactaaatactcaatgaccatctactatcttgaggtatataaatgctaaaagtatagcctttgtagccaaaccgtttgcatttgaatggtagttttgttgtttgatcttttgagttcctttgaattgctttacccaagtgcttcaattcctcatcattaaaataatactcatctcagaagttggctgtgaagaatatattaggatatgtgaaatccttatagtaatgctgggtctaataacaaatatatttaaaattttcttatttatttaccttagtgcaaaatggtaccagattctgtaggagatataaaaagtgctcagtacatatgtcctgcatgtataaattttattttgagttggtaagggtataaatgtaaaacaattagagaataataaagccattatgtcacacttttccacatactattttatcaattctaaaatgtattaggaattaatagataatgtaatttattgaaaactgagatagctgagaataaatgtcttagagagagacttgaggtatgttataatagatgagatagatggagagaaaacccaggtaaggaggcaacacaagctgagattaggggaggaaacgagagtgatgtgtaggatgaacatgctatatgtggagaagaacatggcagaggatctggatggtaaaaatgagagaaacagcagcggattatcatggatgagattagggtagatatatttaaaagccaaatgaaagagtttagacttaggtgaatgattttcaatagggaactgtggttcttctttggggtaataacaaaatggaaatcatatataggcaagattttttgagatagttacacataatttaatgagccaaaaacctaattttatgcccaggcaagttcaagtttgcctataagcatcttttaatttgaaacaggaatgatctagtcaggctctgtacacggttttagtgatatgagacagagggcgctggatcctcccacttgtctgacagtgaagggcacattcccattgtttcttatgttcacttgtgaaaaatgagaaatacagaatcagagacatgacctaatttaaagtccactttgcattattaccaatggaaatatcccaaactctcccagtggcccttaaatattgttttaaaaatgctgctgtgaaaacaaacaccaaattcttgcagataaaatatatttcaccttatgagcttatacagaattcacatcaggctaataaaatagaacatgttgacattgttaaagttaatgtacagtaatttagtacttgctgaagatacatttgaaatttaacatatcagaacagtaggtaggttgaaacaccttggacaccaaatagatattttcgtgtgtccttgaggagtatctatgctgcaatattaattctggaaaaccaccaaatgtaactataatgacaacagtgctgttagagttccacagaattattttcaggttttctttcataattgaatcatattttattattaccctaagatacttagattgcacaactgtgcataaaatcccctgccagaaaattgaggaaagaatgaacgaattagaaggaaataatgaagccatccccagattccagatggatacaaaactaatttcatctttaaggtcctgccatctgttctttttatttattttagcattacacatttacataccttcaagtgaagaagtcaaaaagcagacgcatttgtaatggaacacctcatttaaggggagaaaaggtcaaaaaccgtaatttcttttgtaatgctttggtggagtctagttgtttgttcaagatatgcaaatttttccagtaactgagaaataatcaggctgacaagccatcaggaaatagtaaattaggaaaagcaataaaattgtagcaaatcctataatatggtagtcaaatcgttaatgtgcttttaaattttttcttgttgttcccttatgtttgtttcctttttggtaaatttgaataaggtgtcaaaaattttcaagctggtatagtagattgaatagtgtgccccaaaattcatgtcaacctggaacattagaatgtgactttattcagaaatagtgtgttgtagctttaatcaatcaaagtaagaatctagatgaggtcatactggattggagtgggtcctaaatccagtgactagtttactcataagcagaggagaggaaacagagagacatacagaaacagagaataaggccatgtaaagtcggaggcagagccggaagccaccagaagctagggagggtcaaggaagaattctttcctagaactgtcagaagaagcatggtcctacagataccttaatttcagacttccggcctccaaactcagaggaaaagatagctgttgtcttaagccaccaagcttgtagtactttgttactacagccctaggaaactaatatgactgctaagatttattgaatgtagattttgaaatcttttgaaagcttaaattttttactttcaacattcttacatagccatgagtaaaagctgtgtatggaaatttgaagatatgagagcatgtttttttgcactgagtaatataaatcaaaccagacacatggggaaagtcaatgtaaaaatttacacatgatccgcattcctaaactatgcaaaatgcatttagctactattctaactaaagagttaatcaagaaataaagaagaaaaacaacaatataggggaagaaatgttgtccaaagttatttttaaaagaataaataaaaacgaaaaatctggtaagatcctctcctgtttccctgttgttttaaatctttatcttatttcacagagtatcagttttgaatctgaaatttaatgaagataagcaatatctgatagcatgtttatacttgcattcctaactgctacgtgcctatgggacacataagattgtgaaggtggggagagacacgtatagaattaacagctttcattttactcttcaaatttaagagttggagagtttttcttttttaaaaaatctaaattttaatgaacccttttatagggcaaaaagctttgctattctatatgccttaatcatgctaggatgtgttttgttaaccaatgcatagtgttgtgtggcctcagatttaggagtatgcttgtgtgtggtagtgtatcctatatgatttttttatttgatcagtttcttaataccattgtattttgactactattcttaaataataagacaaccattttttttcaagctgggtagagtatgtgaaatataagaaagcacacttaattaaaataaaagctgaaaattaaaatcttatcaagcttgccttattttaaggagctcagaccattgcaaaaataaatcttgctttctcatttagtttcaggtgaccaagtctctgaatccaacagttctatcttctgcctccaaatgtagcatgatatttccttcagattaatgaacagaaatacattgccattgtagcaacaatcaatcagttaaatcacactttctaaggccatttcagggattttaaattatttttctaaactattataccctgttttcatcatcaccctctctaccaaaaactttgcatgacatttaatgccctgtgaaagaaagtccagactcctctcaccctggcaaagacaaccttcactgataacctggcttggaagatcctttctgatttcctctcctactattattgcctatctgagccctcctctctgtgaagttaggctcatccattcactgttccccaaacactttatgagcatcctttcttctgagattttcttcactcatctcaccagaaatgcccatcactctttgaatgcatccatatccacctaccttgaagccttccttctgcttcctttgaaatcacagctgttactacttggcccagtaatctggcattcaaccacataggactcacaaacctgaaaaacgctgttttttaaaattgtcaagtgatatagatagatatttggatatttgtcccctcccaaatctcatgtcgaattataatctccagtatcggaggtggggcctggtgggatgtggttggatcaggggggtggtttctcctgaatggtttagcaccatccgcgtggtgctctactcatgatagtgagttctcatgagatctggctgtttaagtgtgtggcatccccacccacctctctctttctctcacatacacacacacacacacacacacacacacacacacacacgccatgtgatatgccagcttcccctttgccttctgtcatgattgtaatcttcccatggccttaccagaagctgagcagatgtccagtgccatgtttcccgtacagcctgcagaactatgagccagttaaacctcttttctttataaattacccagtctccgttattttttatagcagtgcaagaacgtactaatacaccaattaatgagtgcaatagatacatttactgactgctcaagtctcactccatgcttgaccatcaccccatgcttgatcaactgggcagttgaaatctgaatcaaagacaacaatgggatgaagtatggcttgacaactggctgaggaatgaggatgaggttccaagccaaggtggagcccaggaatacagtgtcacgataaaggtcaaatgattccttgcaaacttactcatttacattttgaatggttcaattgaacattatgataaaaaagctcaattcaaatggtcatgcaaaaagtatggtacttgattatattttattttatggtacaggtaccttctactatttcttgatatcatatgttattactgaaattcaatggctgacatggatatcaacttgaatataaacaatctgatggaaggacatttctctgacacccctcatatttctcaatatggtacaatctgtgattatacaaatatttgttattaggttagtgctagactattaggtctttgtgaagtacaaatctaaaagaaagcaatatatacttgtgttcagaaatatattcaagaataaaacataaatgccaagaactagtctttcaaaaggcaataggtacaggaacaaaaatttgaatattctcaaaaggataaatattgttattcatgaactgatagcaatatttaaatggtatcatctcctttgcagtgacataatataagctaaacactggggagacgcatgaagaatgttaaaatgtattaatcttgcagaatatactgtggcatattttctaacacatatactcaatagtgaaattgatcatttcaatttaccaatacttgtagtagtactgtaaaacataagtttacataaaaatctcatttttaaaataaaagacactcctgctattggtaaaatttgtttttatgaattaaaaaaaacttcacactgggtttttgaagcattgcattagcagtaatgtttttgttaatttaactcctcatcccttgtaacatttcaaaaattcaccactagtcataattctcttaagaaaataaaaagcagctttgagagctatagttagagtttaagacagaggtcagccaattatgtttgaccatgtctggctgaccatatggccaaatctggcctgccacctgtttttgtatggttcatgagctagaaatggtttcacatttttaaagagttgaataaaacttaaaaatatactattttatgatacaggagcactatatgcaacgcaaattttattgtccataaataaagttttattgaaccatggccatgctctttcatttatctattgtctatggctggtttcatgccatgcagtacttgcagcagagagtatatggctcacaaaggctaaaatatttattatccggcccgttagagaaaaagaaagttcttatctataatttctgagaaggaaatacaaattaattaagctttgcaaaatgaaaaattaattccagataactctcttttatgtgcaattagtcaattggaacattctacgttcaagttatatatattcccagaacatgcaagcacatactcaacttaaaagtcataaattcaataacactaacttaaaacaaattttccaccacaatatttagtgttataattttaacacaaaccaatgagcaagatactacatgccagatgtgacctgaaagtaacaacccgttggtcagaaaaaactcactggactgtgtaatctctaataagtacgaagtggtgatatctaaagcaaacagaataaaatcactctttgtggtaatcagaatgactttctaaacaaatgttaagacaaaaaaattctgccgaaccaccaaggacatcccaagcaatcattttatttttctctctgctttgctattagaggctatctgagcattgtttcttctagatattgagaaaagtacataatttctactaagtatgctacatgcattagtgttcccttaatgattacaagttgtagatctgctaagtgcatcctgaatgcactgaatgtgcaattgttttgcataaacgtgaaaagcagagattctaaataaaaagccgctatttaaccatttgcgattatgctatcatcccacaccatcgcatgtaaatgcacttttctattctctttccagttgctaaagtaaatgaccaggaacagagaaatgccctcatttcttatttattggtcacttacttccttggcttgcatataaaatcaaaccatccataaaatccctttaaaaagttgacacatttagggatcaaattatttcacacaaaattgagatatttccaaaaataggcatgttttgaagaatatctcacattacatgtgcaattgagttcttttcctgtcccaggtacagatttgttaggtgatcttaatcaaattgttgctttcttcattcactgcatactattcctttggcaaatatgtttctgccttgataatgaactaggtactatgtgaagtgttatacagaataaaaagatgaatcagacataactatgatctctaggattcgacaaacaagtaaaagtattaatcatatatatatatgtacaaataacggtgaggtaaaaaatgctgagtgcacctaagagaggtgcagataagatattttggaaagtcagagggagaagccattacctccaactgggaagatccaggaggaatttattggtgaggctgcatttgagctgtaccttaaaaaatggttaagaagagtaaattaaattgactgacaagggcatttcacaaactgacaggtatgcaaatgacaggtaagaatgtggtagatgtgtgtgggtaaagaagaaaatgtcattttttttttttgtccataggcttggatgtgtaaagtggagcaagttatagttaaatctagagacatagcatgagaacacgaagatagtgcggtctggaaggaagcattggactcagacagatataagttagaattatggccctggatactggctgagtataccagagtactttacttaacctctaagtctcttctaatgtctagaaatattacataacttgcaaggtccttgtaaagataaaaaatatatatatgcacattttataacacaatgtctggcacattatagatgtctaataaataatagctattattgtgtcaatattatattgaataacaggctaaaagttttagatagtgctgtaagaagttatcacactcactatggaaagtaccacaaggttagcagtttctgaaactaggaactatttggaaactaaagcagttggagagttagctagtgttttcaactgggactgcccattaaaattatctagcgatctttgtaaatcgtggcataactaggctttaccacagaacaattaaatcaagatctctatccgtggagcctgggcatagtactttataaaagattcccaaggatttctcaagcatacccaaagctgagagctactattgctctagatacaagttgttacaattaatatgataagtgtaataagtccagcaaaatatattttatgatcataacttgagttattttcactctgctacactagtgaatgtcacttttctagatggcctttctctgtcatagtctcctgtttgtccaaagacccatttagcaccaaacaggacccaacacaatcaaggccaaatccatgtttattgaatggtgaataatatcactgactcatattattaccattccccattagatcaaagtgacaagatgaaaaacaatataagataggtaccatgtagcaataattaaaatatttatattttgatccttgttttctttttcaaaagctatcttgcattaaaagagctaaaggttcacatcatgttcttaagggttatagtaagtaatcagctatgcctaaaaattaacatcatgaaccaacacatgcaagggtaagtgcaagactagtaacacatgtcttcagccttatcaataatattatcaataatatcaaagtagtggtcaaccacctgttttcatttttttaacttttattttgagttcagtggtacacatgcaggtttgttatgtgaataaattgcatgcttcaggggtttggtgtacagatcattttgtcacccagataataagcatagtaccagataggtaggttctaaatcctcaccctccaccctagagtacaccctggtgtctgttgtctccttcattctgtccgtatgtctgtaatgtttagttcccacctgtaagtgagaacgtgtggtatttggttttctgttcctgtgttagtttgtttagaataatggtctctagctccaaccatgttgtggcaaaggacatgatattttcttttatgactgcatagtattccatgttgtatatgtaccacattttctttatccagtctgccactgatgggcgtttaggttgattccacgtctttgctattgtgaatagtgctgcaatgtgtgcatgtgtctttatggtagaacaatttatattcccttgggtatataaccaataatgagattgttggattaaatggtaattctgtttttagtttcttgagaaatcaccaaactacttcccacagtgactcaactaaattctcatcagcagtgtataagtattcccttttccctacagcctcaccagtaactgttatttttttactttttaaataatagccattctgactggtatgagatggtaagacattgtggttttgatttgcaattctctaatgattaataatgtcgagcatttcttcatatgcttgttggctgcatgtatgtcttcttttgaaaagtgtctgttcatgtcctttgcccatgttttatggggttgttttctgcttataaatttgtttaagttccttatagattctgaatattagacttttgtcagatgcaaagcctgaaaatattttctcctatcctgcaggttgtctgtttactctttcaatagtttcttttgctgtgcagaagctctttagtttaattaggtcccatttgtcaattttttattttgttgcaattgcttttggcatttttgtcatgaaaatttttgccagggactatgttcagaatggcatttcctaggtaatcagccagggtttttgtagttttaagttttccatttaagtcttaatccgtcttgagttgctttttgtaaatggtataaggaaagggtccagtttcaatcttctgcatatggctagccagttattctagcacaatttattaagggagtccttacctcattgcttgtttttgttcattttgtcaaagatcaaatggttgtaggtgtgcagccttatttctgggctctctattctgtttcattagtctatgtgaccgtttttgtaccagtaccatgctgtttaggttactgcagccttgtggtataatttgaaatcaggtaatgtgatgcctccagctttgttctttatgcttagtactgccttggctatttggactaattttttttttttgttccacatgaactttaaaatagttttttgtaattctgtgaagaatgtttttggtagtttgataggaatagcattaaatccgtaaattgctttgggaagtatgaccattttaacaatattgattcttcctattcatgagcataggatgtttttccatttgcttatgtcatctttgatttctttaataagtgttttttaattcttattgtagatatctttcgcctctgtggttttctgtattcctaggtattttattgttttgtggctactaattcaaaatttcattcttgatttgcctctcagcttggctcttgttggcgtatagtaatgttagtgatttttgtacgttgattttgtatcctgaaactgctgaagttgtttatcagatcaagaagcttctgggaagacactgtgggattttctagatatagaatcatattgtctgcaaacagggatagttggacttcctctctttctatttggatgtctttaatttcttgctcttgcctgactggtctggctagaactttcagtactatgttgagtatgagtggtgagacagggcatccttgtcttgttctagttttcaagggaaatgcttctagcttttacccattcagtatgacgttggctgtagattttttttgggctgttattattttgaagtatgttcctccaatgcctagtttattgaggatttttaacatgaaaagatgttaaattgtatcaaaagccttttctgcatctactgagatgattttgtggtatttgtctttatctctgtttatgtgatgaatcacatttattgatttgcatatgttgaaccaaccttgcatcccagggataatgcctgcttgatcatggtcgaatagctttttgatttgttgttgggtttggtttcctagtattttgttgaagatttttgcatctatgttcatcaaggatattggctttaagtttttttgttgttgtgtctctgccaggttttggtaccaggatgaggctggtctcatagaatgaattagagaggattctcctctcctcaatattttggaacagttttagtaggaatagtacccgcttttttatacatacagtgggtacaattccgctgtgaattcatctggtcctgggctttttctggttggtaggctttttgttaatgattcaattttggaggtcattattgatctgttcagggattcagtttctccctggttcaatcttaggagtttctatgtttccaaaaatttatccgtttcttctaggttttctagcttgtgttcatagaggtatttgcagtttttgtacttctgtggggtcagcggtaatgtccctttgtcagttctgcttgtgtttagttggatatcctctcttttttctttattagtatagctagtggcctatgttatctattctttcgagtaacaaactcctggatttgttgatcttttgtatggtttttcacgcctcaatttctttcagttcagctctgattttgcttatttcttatgctctgctttgagttcaaccattttgaaaaactgcattccagattgtattttatctagaccccatatatagagatcttttaaaaagttatttcatgtttcaatagtcctacaataacattttgtggggtgatgcatcaatcattgttatgatgttaaatttaataataattttacagaaaaacacttttgtattcaaatgtataatagggaatgttgaagtatgctgaggaatatggagactgaggagtgtgtattaagaaaatcccaaaggacccatagcttcttagaatttgaaggcactttcgaaaaggcaacctacaaaataggagaaaattttcacaacctactcatctgacaaaaggctaatatcgagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgcttaccatcactggccatcagagaaatgcaaatcaaaaccacaatgagatatcatctcataccagttagaatggcaatcattaaaatgtcaggaaacaacaggtgctggagaggatgtggagaaataggaacacttttacactgttggtgggactgtaaactagttcaaccattgtggaagtcagtgtggagattcctcagggatctagaactggaaataccatgtgacccagccatcccattactgggtatatacccaaacgactataaatcatgctgctataaagacacatgcacacgtatgtttactgcggcactattcacaatagcaaagacttggaaccaacccaaatgtccaacaacgatagactggattaagaaaatgtggcacatatacaccatggaatactatgcagccataaaaaatgatgagttcatgtcctttgtagggacatggatgaaattggaaatcatcattctcagtaaactatcgcaaggacaaaaaaccaaacaccacatgttctcactcataggtgggaactgaacaatgagaacacatggacacaggaaagggaacatcacactctggggactgttgtggggtggggggaggggggagggatagcattaggagatatacctaatgctaaatgatgagttaatgggtgcagcataccagcatggcacatgtatacatatgtaactaacctgcacattgtgcacatgtaccctaaaactttaagtataataataataaaataaaataaaaagaatttgaaggcactttagagataatctaaaagaattgacttcttacaatttgaatggactttagaaataatctggcagaatttcttgccaaaatcaagaaatgccatttctcttgaaatctaatagcgaagaagaaaaattacttgcttctttgtaaaaacatcgaaaaacctacaaaaatatcaaagtttatttccaacatggaggcctggattttgggacttccttattaaatcttaatatattgacagcacttgtaaggaccaacctcattcaaaaatataacaaacagatggcaaattctacagtcggcagaagtaatgggggtattaaaatgctagcagcagtctccctcatggctcttgttttgacaggtgtctactcaggtgcttgtgttttctaagcaatgtttctctgttcctgtgtataagcggccctcacctttttatgagtatctatgccattgcagtatttgctatacataagacaatcacaaccattaaactgtctctaatcctttcctgttgtggttatataaattatttgtttacactgagagtacatgaaatttttataggcacaatctaggattgcatctatccagctttcctctccaataaattttttgtaaatattcaaactcatatatgcctcaatgtaaccacattgtaaaccctatctgttgctttcacagaaaccattcaagctggataaatggcccacctcatagcccagggaagaactcaatgatcagattctaattatctttcttggttcacttaatagccttctcctctctcatgggggaggccagggataccctgaaaatgtggtctcagggaattcattgcagtcatgtcttcttaaacattcatatacaaatgattcctttaaagttattcatacaataaaatgtcctagacactgtgttaggatactatgatgaatactgagggtgctatgatgaataaaggcagtcactgccctaaaagaacttgcattaaaaacaacaataaacaaataggaattacagtagaaccttgaataatattgttcttggtcaacattgttttgttacaacattgataaggaacttcccactggggccactgtctgtgtggagtttgcacgttctgcccatgtctgcatgtgttttctctgggtacaccagtttcccccacatcccaaagctgtgcacattcggttcactgacatattaaaactgtccccgtatgaatgagcatgggtgtgtgtgagtgagccctgcatgtaatggaatggggtcctgtcctgggctgcttcctgccttgtgcctgagctgctgggtgacactccagccatctcagaccctgaactagaataagcaggttgaaaaatgagtaaatgaatgaatggatagatggatacatattgtaaaaattcataaattatgtgataatcatacaaccctacaataataaatgatgtggcacaaaagtgcttactgagcccatcatatttgttgtttgtttttgagctgtgtggtggtaggaggtgcttcttacaattttcacttttcagacaattattccttgatttaacccaccactatgaccaccatcactcactgattcaccaaaatttgggtaaataattatcttacttgtttctttaatatttcttaaatgtatgtatatctcacattcatttcaatgtttaatattagaagtggtgtgggttatttctttagaagtttggtgatgttagccagccactgtgggtcacacctgtaatcccagcactttgggaggccaaggaaggcttatgacctgaggtcaggagttcaagatcagccagactgatatggtgaaaaaccgtcactattaaaaatacaaaaattagccaggtgtggtggcacatgctgtagtcccagctgctcgggaggctgaggcaggagaatcacttgaagccaggatgtggaggttgcagtgagctgagatcacgccactgcactccaacctgggcaacagagcgagacactgtctcaaaaagaaaaaaacaaaaagaagtttggtgatgtttttgtgaccagaaatatgcttaaaatcttaactcctgtttatatcaattagctttgtgataaaattggctttcattatatgtatgctgcctaaagttacagtttctaagaacttatcagtgatgttaagtgaggatttactgtatgtcagataaaaatatgaggtatgaataaaaataacatacattaatagatacagagagtgactagggcaggggatactactctagaatgatggtcaacaaaggcctgtttgtggaggggatatggaacagagacttgaaggtagcaagaaggtcattatcaaagagaagactattctagagagagaaaaaagctaacaaagtttgaagaccaaagtgtgctgggaaaaaatgagaagcaagaaagacagaattactggagcagaaaaggagtggaggacagtagtaaaagatgaaattcgagaagtttggagctgacatggttaattttacgtgttaatgtgactagaacaatggttcccagctgtttgatcaaatatcattctgagcatttctgtgaaggtgggttactggccgagattaatatttgaattggtagattgcataaagcagattgacttccctaaggtgggtgggccatatccaatcagttgaaggcttaaataacaaaagtctgccctttcccaaagtaaggaaaacttttgcctcctgactacctgtgaattgagacagtagctttctcctgcctttgaactcaaactgaaacatcagctctgcttgagctgcaagccagccatccttgagactgcaatgacacatccatttttcttgttcttaaacctttggactcagactggaaggacatcattgactttcttgggactccatcttgctgactcacctgcagttcttgtaaattagcctccataatcacatgagccaattctttacacacacacacacacacacacacacacacgcacacacatatatatatataatacaatatataatatatgtattcatcctattagttctgtttctctgaagaaccctgactaatacagaagcttaggagtagtatgttctacttactatttaaaaaatcatccgctatatggcatggtcagactgcagtgggatgggacagggataaaatcagggagagtagctaagaagctttgcaataatccaggcaagagacaaatttgtggcttttactagggaggtagtggtagatgtagtgaaaattagtgaaagtccatatatatttgaagattgagccaacaggatttgctgatgaggagctggagaagatgaaataagttgaaaattatctcacaggccttttgtccttgggccaaaactggaggaatagagttttcagtttctgagatgggaatggcttgagctgatttgcagggctaatttgaagttcagctttagagcattttattttgagaaatgtactggaaaagcaagtagggaggttgaataagcaatcaggcatgttagtcagaagttgagagtgaaatttagcaacagggtgtctaattgtgtcactaggaggagacctcctagtgatctggtgtggacatagaagatttcttcagaaacgggggtcatctcacatagttggtaagaaatatttcataattcatatagcacctaacaaaatatagtttatcacagaattcagtcatatgtagaaatggcattgaggtaattaacagcttttctgtttattttgtgtcaatttctaccaaaatcctaccaaatcataagctgctttacttatttcatgagtcatattaaggttattcaagtatgtgattaatgtgtatgattttctatgccattattgtttttagattatatagatctaataggcagatagctcatatgctatggttggaatatgtttcccaaagatcatgtgttggaaacttaatgtccaatgcaacagtgttgggaggtggggcctaataaaatgggattaggtcaggagagctctgaacaaaggattaatgttgttatcacaggagttggttagttaccatgggaattagttagttatcatgagagtgagtttgttatcaatgtaaattttgccccctcttgctcaccttctcttgtactctcctccccttccaccttcccatgtaatgacatagtaagaaggccctcatcagaggacagcaccttgatattagttctcccatcctccagaactatcagaagtaaatttcttttctgtataaattacctggtctgtgggcttctgttatagcaaaacaaaatgagctaggacatcatattaacatacactaaagaaattattctgataattatattttgtaggctaaccttaacttgaaatttgactctagctagtcatccctattttctatcttgatctgaaataatttattttggtttcattatctataaaaaaaaagtttctattttgcaacattgcaaacactgcaatagaacgtctcatactcaaattctgttatagagtgctcattaacatagatgtagcttttagatattttatgtagacttagataaattaaatagcttcccaatatacatagaaaacctaaaatacatatatattctttttatgcccatgaaaatgcaatataaaatgtctgttataaaaatgattgttatattaaaatacggaattgtatacatttagatattttataggataatgaaattgttttgctttttctcctcagcagttagagtggcatattttagagaaaaaccataaaatattggaaagagaaaaggattgagggtcccaattatgcaactgttgggatgacaccaaaaaaatcatttaacctcttaagacatcatttttccatacttataaaatacagatattgaagtagattgttaatgttctttatgagtctaacatttatgaatgctatcatttaacaggcatggggtgtgtgtgtgtgcgtgtgtgtgtgtgtgtgtgtgtgtgtgtaaatgcagttccaaaaggaagtatcattttactccaggcaaattttcattgaccatattttatgcaagctacatagtagaaatacggtcagagtacgtatttctatcatcatgttaaaaagacataaatataaaggtgccagcattttgtcagtaaataatcagagaatcagtcctgaacagtaaattcgagtatgtgtgcttttatcacaaccacaatgtttcattaatgtgttttttcttgctgaatattctcgattccttgaaataaattttaattagccactttatgcatataattttcatattttcataattatacttaattatgctcttggcacaatttatgtaatcaaataattgccatatgcaattatattatataaaatatgtaaacgtaatggaaaaaatcacagaagatgtattcacacaagatatttcctttttcattttcagctatccacattatttagtattgattttaacaatatttatttttagctcaaatcactagatatcaaagagaagattatattcttaaggggaaaatttgacagtgattctgcatagagatggtatattattaaaatacaccataagttgaacatttgaataaaagtaatatgtaatatgcattttttcaggtggttttaggaaaaataaaatttacgttttgcttttacccttaatattattgatttgtaatgtgttaattttatttatagctttatacattcttatctatactcttaattgcctatacctaaatatggaatcacagaaatgcaaaaaaatcaaagaaattaaaataaatataaaggttatctaggtcatatccacctaacactacaccttgagaaaatgatgtcctgggaatttgactgacttcacatagtcacaaagctagttcagttacttcacatagtcacaaagctagttaacagcaggacacagcctaacctcaggactcctgcctgtcagtacagggccttgtccttctataccaagaggatactcagttcagcacttataggactgtgttttcaatgatctgcttttgttttttatcttcttcccttgattgtgagatctctgaagaaagagattaggtcttcacctttgcatcctccactagagcttagaatgttgcctacgcatcatcataattgctcaacatctagctttttggaggcttttattttgtgcaacttttgtgaccattttacaaaaataagtaattgtctcctcatctattttgtggatacacaatgaatgttgacctaatgacaactggttgaataccttattgcaaaattgagacttaatatttgaaacacgtattttatttgactctacaaaatataaaatgtgttatgtacacatctaccaagaactcacactgaatggtaattgtagggtattgggtaggagccacgaggtattataaattttctggcactcccatggcagaactgtttaaatgatgaaatttcatttatagcaaaattatcctaactcaaacactagtgaaaaggaaaaataaaaaaagaaaaagaatagctgatagacagaaaactaacatgactgatatggtttggctgtgtcctctcccatactcatcttaaattgtagctcccataattcccagatattgtgggaggaacctgatgagagataattgaatcatagaggtggtttcctccatactgctctcatggtggtgaataagtctcatgagatctgatggttttataaggggtttctcctttcccttggctctcattttctctcttgtctgctgccatgtaagatgtgcctttcaccttctcacatgattgtgaagcctccctggccacgtggaactgtgggtccattaaacatctttttctttataaattacccagtctcaggtatgtcttcatcagcagtgtgaaaacagaataatacaataactatatacattttcattatcttcagcatgcaagttttctctctgaaacaactcaaaaactccatgtgtattagcattttgttattaagtaaatgctcctctgggtttctgtcctgaggttccacagggtggacatgcttttattttgtttctattgaataattcacagaaagttattaattgactaacaccaaaccaatgacaaggttgaagctcttaattgcatattgtcctcacatttgcaaatgggaaataaggcactgcccaggacattccagggggagatacaaagaaggataaactgaggctctattagctctcacattctgtgttatttttatggagtgtaactttggcttcagaggatgagggtacagagaggaagaacataaagcacctgactcctcgcctctattttctgaggtagattgctcttctagccgagactgaaataaaaaatagctctcacgtctaagttcaagcctcaccatgtcgttattgggaacaaaaagcaagtatcaatgaacaaaataaacaaaatactctgaacatgcaatatgagtctactatatctcttaaaatcaatatttttcaatgtacagatacacatttacatttaaaaagaatagttccaattgtcattctcttcacgtgtctgccacacaaaaactttttaccattacagattaagccaaggcactaccaaaaaaaaaaaaaattaacttagtaggaagaattgcaaaatgccaaatatttttctgctttaaatttgaatgtttttaatattagcatgtactttcattaaggagtgggcctactagatacactgaaggtatttgagtatttatgataataataatgattgctatataaaactataattagccaggcatggtggctcatgcctgtaatcccagcactttgggaggctgagacaggtggatcacctgaggtcaggagttcaagaccaccctgaccaacatggtaaaaccccatctctactaaaaatacaaaacatagccgggcatgggggtgtggtagctagcacctataatcccagttactccggaggctgaggctggagaattgctgaaacccaggaggcagaggttgcagtgaaccgagatcgcgccattgcactccagcctgtgcaacaagagcaaaactctgtcgcaaaaattaaaaaaaaaataaaaaaaactgtaattaatagacaaacactggcagagcagagctgcactgtcctgggctctgtgtgttgacataaagagtcaaacaaggccaggcacagttggtcacgcctgtaatcccagcactttgggagtccgaggcaggtggatcacttgaggttgagttcgagaccagcatggccaacatggtgaaaccccatctctactaaaaatacaaaaattagccaggcataggggtgggtgcctgtaatcccagctactcaggaggctgaggcaggagaatcgcctgaacccagaaggcagaggttgcagtgagccagtatcaaaccattgcactccagcttgggcaacagaatgagactccgtctcaaaaaaaaaaaaaaaaatcagacaaagtgcctaccttcaaaaaacttactgtgagcatagaggagacaaaatggcacacaaaatgcacttgacactatgaagcattagtgctaaaagctaaataaaagttagagatgatgagctcataggagttttaaaatgctagaagaaacagaaaaacttttctggagaaaatgaaacaccatgggccttaaataagagacaaaatgtaaattcacaggttgcaaactcaaatgcctatcaaagtcagctgaatattgctgggtaggaaggtacctacagtgttaccaaatttttcaagagaatctagaattctagtttgacatgtaacaaatactgactttttaaatagtgtcaattaactcaaacaattaagtgctgtataagccaataaaaacactatataattatggtctgcctgatttatattttttgtcatgtcctcaaatattagaacagggatgagatggcaagagaaactgcatgagctacatggctgtgatgagaccggatatagttaatttaaaagaacaatcagggctgggtgtggtggtcacacctgcaactcagcactttgggaggccgaggctcttgtttttcaagaccagcctgaacaacatggtgaaacctcatctgtattaaaatacaaaaattagcccagtgtggtggtgcacacctgtaatcccagctactcaggaggctgagacatgagaatcacttgaacccgggaggcggaggttgcagtgagccaagatcatgccactgcactgcagcctgggtaatagagtgagactttgtctcaatacattaaattaaattaataaataaaataaaagaacaatcagaaggctggtgcaggaggtaagtagtagaggagacaaactggggtcaggttggagattatttggggcatgaataaaagcatttatattgattctggaggcagattagagaacaagtacatacagaggtgtgagaggctaagtgtatcatcttgaataaagtcaaacttctctttgtgttggcattcatcctgtctgccaagtataatagctgagtgtaacccaaggcattttagaaatgttagaagtgtcaggaaccatgtaccacacatagacctcaaagcaatgttgctatattagtcttttttctttaacttacctgtaatcataaaatattgatttaaaaaccaagactactaatatttcacaacactatattcacttctaacatactactgtcaggttaacatttgataattccaattaaaagggtttaaaatttttataggatttaccatggcagtatcccaaggaaacatcgtaccacccagcttggccaagcacctaggccatgtttcagctgagaatttttttttaaacttcattatatgaacatttggtgtctcctataaactgacaatccagtttgttagagatacaatatgcaaattaggaaattagcaacaatttctgatgctagtcattactatcctattctccacttcagatttgcaaaaacgcaatgatgcagtaaactataccaacggatgttttgctacggctattaatggacaatattttattgtaatgttaaatttactgcaaaacttgggaatttacaatagcatacattatcctacacaatctaatataattcaatttcctttgtcctatgagaaaaacaaataaaggcaaaatatattgcaaacatactcacttgtgtgctaactttaccatcttattaactattcagtcaaattcagtatcaccccaaatgctgtgaacaaatttcatattcttcaatgggaaattgaagaatttttggacttcataatattggtgaacattctaagctttagccatgtttttctgcttaatctaatttcaccatctctcctctgttcattgattattcctattgttactccacacactgatgcctaactcccactcaagaggtactaagtgtatcagaagccattattgtaaatgtgcagttcaaattttttcctttgctgcacatttgtttatgattttctttgtagggccctttgaccatagattctcatacctaaattcaacaacaaagtcagaagtgcttttgtttggaacaccctcaccattgtcctgaggagtctacacagagctaaaaaaccactatgcaaaagttcaagggaaaccagttgatgcactgtggactgaaggcagaagctgctgacttctacatttcaataaaactattatgaattgcattttagaaaaagggctttgttgctggtttgttttgctctgctggttttgttcatgtgtttgtttgtttgtttgcttgattgcttgtttagagagctaaattacttctgtaaaactcattggcagaaagcagagggcgaataaagctgaccatcttaggttgaagaaaatcatataaacaccaggagagcatcatcaggtaatttgtattctctgatttaagctatcactctgctttatacaaagaaatttaggctgggcgcggtggctcatgcctgtaatcccagcactttgggaggctaaggctggaggatcacctgaggttgggagttcgagaccagcctgaccaacctggagaaaccctgtctctactaaaaacacacaaaaaattagatgggcatggtggtgggtgcctgtaatcccagctactcgggaggctgacgcaggagaatctcttgcacctgggaggcggaggttgcggtgagctgagatcgcaccactgcactccagcctgggcaacaagagtgaaactctgtctcaaaaaaaaaaaaaaaaaaaaaaaagtactcaacaatatgtttttctaatattaagtacatatggacaaagaattcccatcaaaatttggagataaaagcgacaaacttacaaaatgaagtgctgttgaagtacatgtactgttctggaatctttacattgaacaaccacagaaagataaatgtcagagaggagaactcatcaataactggcatctattagggattttgaaataatcataaatgccagagtttaaaaggataattttctttgactatgctactatctcataattttatacgataaatttcatgcaagtatttctgactcagtcaaatcaatcttcatctttactggacaaaaatattctgaccaataaattttgcacacaactatagtattatctatattagcactgcacaaggtataaattctgagactatattctctattgaaacactatcagccaaattcattttatagcccaatgaaaataggtgattttataacaaaaccctccgtaacatacttttaaaatgtctatccacctgggaactaaacatccattaaaatgcccaaatcctaatcttcatgatctttgcttatttggagaagcaatttattttttgtttttgctctttgcataaataatcttattttatccatgctgcaggtgttgttaaccacattttatgtatgaggaagcaagactcacagaggttaaaaactttcttaatttcacacagctattaattataaacatcaggacacaaattgagatttttctgattctagagtttatgttatttttcaaaaaaataattttcgctgggttcagtggctcacacctgtaatactagtattttgggaggccgaggcaggtggattgtctgagctcaggagttcaaaaccagcctggccatcatggtgaaaccccatctctactaaaaatacaaaaattagctgggcatggtggcgggtgcctgtaatcccagctactcaggaggctgaggcaggagaatcacttaaaccccaaaggtggaggttacagtgagccgagattgtgccactgcactctagcctgggtgacagaacgagaccccgtctcaaaaataataataataataataataatttcaacttttatttttgattcaggtggtacacgtgaaggtttgttacatgggtagattgtgtgatgctgacatctagggtgtggatattcctgtcactgaggcagtgagcatagtccccataggtagtttttcagcccatactcccctccttcccttccctgtctagcagtcctcagtgtctactgttgccatctttatgtccatgtacactcagtgtttagctcccacttgtaagtgagaacatctgatatttggttttctgttcctgtgttaattcacttaagataatggcctccagctgcatccgtaatgctgcaaagggcataatttcattgtttcttatagctacatagtatttcacgatgtatattaccacattttctttatcccaattcaccatggatgcacacctaggttgatttcatgtttttgctattgtgaatagtgctgtgatgaacagaggagtgcacgtatgtttttggtagaatgatacctttgggtatatatacccagtcatgaaattgctggttcaaatggtagttctgctttaagttctttaagaaatctccaaactgctttccacagtggctgaactaatttatattgccaccaacagtgtataagcatttccttttctctgcagcctcaacagcatctggtttttttgtttgtttgttttttgttttttttttactttttaataatagccattctgactggtgtgagatggtgtctcattgtggttttgatttgcatttctctgatgtttagtgacaatgaactttttttttcatgtttgttggcatcttgtaagtcctcttttgagaagtgtctgttcttgccctctgtccattttttaatggagtaatttggtttttgcttgtttcaaagaacccagaaataaagccacataactacaaccatctgatcctcaacaaattcaacaaaaataagcaaaggagaaaggacgcccccattcaacaaatggtgctgggataactggctagccataggcagtataatgaaactggacccctacttttcaccacacacaaaaattaactcaagatggattaaagagttaaacgtaagacttcaggctattaaaaatctagaagaaaacctaggaaatatctttcttgacatggatcttagcaaagaacttatgtctaagttgttatttatttccttctcttctcaggggcttcttgatgaaaggatgagttagtctggattctccaagaatcagatgccaacacaggattaaacatgtaagcattttgagcagggtaggaaaggtaccagagctaccagattcaagtctgatgcagagacagtgagggacgtttgggtgggagcctcctagaattcacattctaaagaaggttaataaagccatttgggagtcctcaagtcacagtcattcaatgagaggggtccatgagtctcaggaacaagtgtaccttagaactcctgctgtgctcagtcattgtctgtgaacagccctcagagagcatggccagggtacaaacatagtgatgaatatcagagctcagcagctggaaactctggccaactaccgcctccataattggaggaccattaggtgtattcacagggctgcaaaaaggaacaattcccaattgaacctcttacaagttttgtcatatttggaatattattaatctctctgagtcatattgaaagaaaagaactgttatagaaataaatgtaataaaatatgtgacagtacctactgcagtacctatgcaaagatattagctatttgttttccctctaacatccagttgattgcctgtgtacagtaggtggttaagtaaaggtattatatttaaacatgtatacataaatatacgtaagaaaaaactatacccacatgcagtatgaatataacttcgtttcaatttctctgtttagaatttaaagaatatttctactgaatttcatgttttctctttaaactgaattcatcctggtatataccaatctatataattttcttttctaccaaaagaggtatttgaccaagtgaagtactagactgacaaggttctgtctcttaaaaacaaacaaaaattacacatttctttacctgctgtgtttattcgttcatttatgttattcattcaacaaatatgtaaaactctgtgctggaatccatgctagggaaccagaaacagacactattcctacttctgcctccatttggcttacagtctagtaggaagaaatactttagccaaggttcacgcaaacaaacctgaaactgcagctgccacagtgctatgaaggacaagtgcagtctgtaatgagatcctatcataggtggattagatgcagccagggagatcagcaatcgattgctagacaagtggtgctgatgacgaatttggaaggtaataaggataggaaagaatgtccaaagcagaagaaacaaattacacaaagtccagtggtgggaagaaagatgtgggagaagtttcgtgtggagaacaaataggagaggagcaggttgagaagctgcagacatgaggaagggccaggaacatagtggttacataactgtcccaaaaggctacagctgaaaaataaacctgggtcctattcatggattctcatcacactgaatgaattaccagtgtccattttgtcacttttgcttttaatcactgttatttaaaaaaaaaaaaaaatagaagaaagtaaatagcagaaaacagggaaaatatcagtcaaccagttccaaatcattcaatagtatttaaatggcataagaaaagtgatcaaaactaccaaaacaggttaagcctcacttgctttaagcctcttgctgattcaatctatcaatccaacatcttaattattattggaccatatggaaggtagttattcaataatacgacaacataataaaaagctttaaaataaaaaaaatagtaaatctgctaatccaatctcacagagcaaaacatttaaatgtcatttgagatattattctcagttaagtatcctattcctgtgcttatggcatgacaatccgattcatgcaattattgtggagaaagagtagtaaaaagaagcaatcatccactggctcagagaccactatcatagctaagacaccctatggattaaaagagtccttaaagcataagagcacattcagagttttatgtacagtataaatgcttagctgtttttcagtgtcaggtgcctacagatttgtggtgtgtggctcattggctgacgtgttaaatccccaaaggttacatcaagcaggcccaagacttgtttaagaaaaattgagaccatgccctcagtctcttaagggagtgatattactaagcagaatacataataaatatctgccttcttccagaagaaacaggaaatattttcctattttccttactgttatttcttcagggaaagatctgatagttggtaaaatgggccatagggtagcttcactaagcatttctaagaattccgctctgaaaacttgtcggaaaagaaaagcaacaacaacaaactagttaaacagaaaactgagcatatattaggataaacaacgaaacagaaagtgctaggcaaatcactaactctcctaggaaattaaatgaaattgagataaagaacatttgaaagaaagcctttgtattaattttgtttggaaaaccaggtattgttgaagagtcaccagatacttctaaaagtcactatttcattttaaaatgcatctgcctacacaatatgcaatccttatttgacctaattctttcaataattcattagaatgacttttgtcaagaatgtaatgtggatatatccttatacacatttatatccatgcaaatcaaattttagaatatgttatagtcttcaactcacctgcagccatgattgaaatctgggccttattagaatttttttttaaattagagaaattctaaattcggccctaacaatgtttaaccttagcaggatcaagaaagagtatggttgctgccaggtgtaaagaaatgcaaagatgggcaagcaagcaggagcaagggaacagaaataggaacaagaggaaaaagacaagaaagagaagtccccaggcacagataaggaggaaaaaggtaacttataaacagttgttctgtgacatgcaaactctggagattcttattaggttctctgcataaacctttgctttcctcaagaacagttttgtttattttgttcttttaaagactagagtgagttacctgggaagccctgagtcacataattcaaaaagcagtattgctctctgcctttctctgaagacgctcaggacagagaaatggactgagctgcctgactttcttacctctgcatcacctggcacctgtctttccctcctctcactcctacttcatggttggccagcttgttttgataagaaatcctgcctgtgttccttttgtgaccccatcctggacctcagtatggtaagggtttgggcactgtgttctggcctattcttagcaattcctaaccaatagattggccaagccccaaaacgtaatgccaacctcagagtttctaaatagatggatcagggtatggcgagggtttaatagggaagacctaggaagcatctcttgaaactgttcttttgcacagcaggcacattgcttctcacctgaattatattttcttgaagtggactggggccagggattaactccagctctgatgctggctccagcgtctctttcaccaatgcctgctgccttttattactatctcatgaactgtcacctatcaatgcttgcactggagccaggaaaagtgacaagttagaagcctgataagattctctcaccatttatctgtgagatggccatttacattgctcctagggaagcaatgaggaagtctttctaagaaaataaatccagctttcctgcttcgggcctcatgaccattctcaattactgacttttgaactcagtttagaatcacccctttttattccatatcctctattcttgtcttgatttagaaaaataggaaactccaaccttaggagagtaattttagatcctatgcaaaatgcaagaaaatggattctatttttgtacccagatctaacccagagacaaggaaagtttgtttataatccagatttatagagatttataatgttcaaaacttagaaatattaagtttgaaagtctaaactgttaaagtcgctaaggcactagtgctttgtataatttacccactacagaaatgatttgtttctatggtgggtaaggaaaatgtagtttcaataaatcgttggcagttcttgccaggcactcggttttcggaagtcaggaaaggaaagcaatagcttggatacattaaaggaagaaagtatcaccactcaccacttccattgtcccttcatttttttccatgaatgggcattttggacttgatatcaaatcctatcttccacatttttctctgtatacttgttgaagttttttgtccgttaaaactcagataaatctgttaaatgttttagaatacaatagagttctaaatccggctcacggcagcctcaacccccactatttgcagcctcaactcccactattgaaacgaggcatcacacccatgaaaacatatgaaacagagcagtgcatacaatttcacaagcttcacggtaattcaaaacgtttgtaaattccatttttccccagcacgctgccagtattcacaacaaattaaattctcattcagctgatctgctaggaagcataacaaacaagagtgggcatgaaccaaagtgtcttccttttattactttttcttaccatttattttgatgttctaaatggagctgccctctgcctgtccatagccattataaccctacctgattctaggagcaactgtggtcaaggtcgtcacatcacagtctcctcccacaataaaccatctctctcataattcaggctggccctgcagtcaccacagggaacaggtccaacaccctactggaccagtagaggtggctttttcatacctgtacagtggccctagcatgtgagttttggtgggacacctactgccaaaattattttggatagagccccctttgtgaatagattcatccacctgcctgttttgcaaagaaactacagaaagataaatgtgactttgtacaaaccaataaagtgatatttatattttcttaaataatgtgagtggtaaattaactatttttgagcaataactgtcaggcactgtgattagtgtcttgtagactttgtcatttcatcatctcaacaattctgtgatagaggtagttattcttaccattttacagaaacacattcaagacagccaagtccccaaagccacagagccactagttgcaggttctaggatttgaacccacaactgtctggctccaaaggcttgtgctgttacctgtgtagccccttcctaatcatggtattaagacattgatttaaagcataatacagcaccaacatttactactatgaaccatgaacttgcctgggccattaatgaaaagactttaaaactctgcttataaaaaccaagcaaagatagtatcactaggaatcacaatattcatcttaagacttctaagccacagacctcacactcgaaataaaagtataaatcccatcataatgttaacattaactttataaggaaccaaagtctatggatcgtataaagcaaattaagaatacctagtcaatcattcaggcatctattctcaataaatcttaccacacactactgtgtatttagcatcttccagagatctttgggatgtacaagagtatatatagcacctgttctgcaagtgacctagtagaagagataagacaaatacccatgaagagttaagtaatgataagagtcaggaatgccagctgaatgacacaaataatagatagaatgagcatacaacagagatagagcaattatcttggactcttgtactgggaacactcaggaatagatagagacagaaggcagagtgaaaattatgatgcagaggtagacctgggcaacgcatgtttagaaaagcatgagtttaatgctggaattgggaattgaagttgagtgttcatgttggagatagatgcatagggataagcttagaaatgtagcctggagccaaacaataaagtcttacctgacacatactgggaaatgtagagagtatacataatcaatgctggaggaaggaaggttgaagatgttgcagcaaagaactgatataaaccagtgtttaaagaagattgttctggcagcaacgttcagaatgtactatagatgtcagagaacaaaaccaggaagacagtatggagacaactgcaggtaattgaacatgaagtgatgaagtccagggaaggaaagtgaagagaatgaactgaaagtatggttgtgataatgctctgtgtttatcaggtcccctttcatcctcatctacctggacacacattccctagttagctctggactatgagctataagaaaaaagtaggtacaagctctttaggtctctttcttttccatgtcatagggaactaaaagccacatttaagagtaaagagccacaagatggtatcagagtgtattccccaagtcactgcataaagagagctaccctggagagctgatggacaggcagctgactttgcacgagcaaaaactagacttgtgtatgttcagctattaatgtttcagggtctgttactcaaacatagcctaatctcttcctactaatacaaagataactgtgtcagaatttatagctgtgctcagggactttgatgaccctagtcttggaaataaaactaaaaatagacagcagctagaatttgccagtgacttaaaaaatggcactaacacatcacatttagagaatacctgctaggcaatgaaagcaatgacactttttttctccatttgtgtttcattagattaactgtgggttttttaatcataatattaattaagtctttgacaaaattcagaatttcttttgctcatagcaaatggcagccgtttgcataatagcagttttcctaaaatgctaaattggaagctaagtagaactacacgtaaccctgaagttacagccttacaactcttaggaagttctttcagttttctaactatataataatagaattaaagtagataagaaggaaaatgctataagacattcatctgcatgtgtcagcacagggctagccatggagaatgttgaattaagcaagcagagtttcatcctgccactcagttcacactctacgtcagctgtcagacactatcaggcagcatcctgggtgacctactggcaggtttttccaaatcattctaattgcccaattccagtacccatggatgtttctactcttggagtctctaaaaggaaggaaacaggatgaaaacaacataagaaacagtttatatgaactcagttccaacattactcaagataatgcactggtgttcacacacaaagccaaataatctgagttaaatggtcttccaacatagaaaatgcagaacaaacaagcaattatatacaatctataaagtctatgagtaattgagtgcaatttatttaggcaaaagctagcagagctgtgtcctctgtcatgatgtagctgaataccctgtgtgctggattattcttatcacagtggacaacctcacaaaaattcagcctacaaaggccttggcttcagtgatcaattgaggactcacaccatataacatgattctactagaagctaagagcacttcatctgtacccagaaacatattcaaataaataataactttagatttgtggtgcttgtcatctaatgtgctgttgtcattcttgggtgtgggcccttgggtataggctttacaatattctagtaaggtggctgcaatgacactgatcagcaactctctttttcaaaagagaagatgctcacaaagcctccagcaggattaaaagagcaatctgtgataatgcaatagaataaagctaaataactcacatggaaactaaattcataatcttggaaactaaattcatgatacactaggactgagcttttctttaactaatagagctaattctgagaacaataaccaggtaatgtacgatgacaaacttcaaactgcaaactaaattttatactatatctttattttagaccaggacctagcctgaaatagttcagaaagccttaacaaatgaccttctcgagttgtggaggagtgccaaatacacatgctgattctatgctacattaggtcactggcattttccaagaggacacctacagattctctacataggacatggacatgaaaatgccctatacatatcaaaatatttagcagcaacatgccactttggatagcattttaaatcaggttcttaggggtctttggtgggggataacgaaagggtggagacttcattacactaatcctgatcaggcaaacccaaaatgtacctcatgtggtcatggaaactatttgttttaattcaaaattaattaaatttgagttagagcagaaagggaacagtcccatagctttaattgcagacactcaatacaacacaaagactggcatcccagtgcttttggccttgaatttcggccatcaaaaccattagtcaattcagagacagagcttgaacacttgactgcctacactcaaccccatctgctatgtgcaccattgccaatacacagtccagtgtgccaatggcaccatgcattgacggttcttacagagcatgaaagatgcttacatacttccaccaaagcaacatggtatcatttctcctactggaagaatattctacttaaaagcaacactgtgaatctgtacttgcttattcctttcttattgcttcaaaaagtagaatatataacagcacaaaggagagtttggggtttgagcaaagcaagaataataaaattagaagctacagaacaaatgagtcaaatatatattgagagaagtgaaataatttatcaaggggaaaaagatgaaagcacaaaagcatggaaacataggatgtaaataattgtatttagactattttaactttggcctaattgctttcacaactgttataggagataaaattattaatctaataagcagttcttaacatattaggaatacctaggaggtttttaaaaaccccagatgtgtgggcaccatctggcccctagatcaattaaatcagaatctctggggtgggaccaggcctcaggaattttttaagagctcctggagattgcaacgtacagccatgttttagaactactgccttgaacaaaagaatgaagtatcagttgtagagacaatgttgattcactgtactgcaagaaagaaataagtattcctaaatatatgtatgagaaaagatgacttacaaagcttggaaagtttgcctaaggccaccagctcataggtggtacagcgagtgctcagatccaggaccttacgtggactgacattttcactaagatgtactgaagcctcagggcagagatcatggaaggacaggctgagtgggggaagaaagcaagtctttggactgaggagagctctgataaaaatgtcacttcacatccatctgccacagtgattcctaccatttagaaagttatgccaaggtcaccagaagtcccagatataatgcaaagcctacagtaataattaagtgttattgttattacaactacaaattatcacacacctgttgcacctaaaatgctgtcttcagtgccttacatgtatgacctctgctctgcattacatcctgcaaggtagataccaaaatgcccatattatggttgattaaagtgagtgttataaaagttaaataattttcccaaagtccttaattattaaatggcagagctaggatataaaatggctgcctgctcttttttcatttttatactatgttgcccaaaggagttaaatattttaacacaactactcctaattattttagtttagttagcagttatatcatcagctgaggtcagaagatgtgagagagatgaattgaaggcaagggtggagtatgtaagatatggtggtgtcttagttcattatgtgttgctaaaaaggagtatctgaggctgagtaatttatttttttaaaaaaagtttatttgactcatgattctgaaggcttgaaagttcaagactgggcatctgcatctggtgaaggcctcaggttgcttccacttatggcagaaggtgaaggggagcttgcataggcagaaatcacatggtgaaagaggaagcatgagagagggggaggtgccaggctctttttaacaactagctctaatggaaactaatagagtgaggaagggcattaatctattcatgagagatctgcctccatgatccaaatacttcctattaggtcccacctccaacactaaggatcaaatttcatatgaagtttaaaggggaaaaaacaccgaaaccatagcaggtggttttaaaatatgcacatcaattatttgatgcacctcccttcaagagtggagcttaattttcttccgtgtgtgtgtgagctgtatttagtcacttgctaccaatgaagagaatatggaggaattgtatgattttcaagcctaggtgataaaaggtatcactcactctgggaaaagccagctggcctatcaaaaggatatttcacaaaccccatggggagacccatgtgacaaaggactggggcctcctgccaacaaccatgtgaatgagccatcttggaagcagatcttccagtcccagtcaacacttcacataaacacagccccagtcaatgtcttgacagcaacttcctgagagatcctgacccagaaccagagctaagttgcttcagaattcctatctcacagaaactgtgagataataaatatgttatttgaagttactaagtttcagtgcaatctgttacattgcaatagataaccaatacagaggggcaagaaacagagggaggaagataacaaaaggtcaagattatgtgattcaatgatgcattagagtttgggcaatcctgaacacccaggggatacccgtgtggtagtaggcaagtcataagatatgagaaggggttggggtaaagtaagagcaaggagggtcataagttatttacaatagctcttttgcaaaggaaagaaatactgatttgagggtaaattcattttcccaggttattacatagcttgacagcactgtatgtgatgtatcaaagggcacccaagaacctgaagcaataatgcatcatccaaagtcaagtaatttacaatttactcactggcaagatgagactactgtatcagagagaatcaaaagacatccctcatcgtgtggaaagataagtcaggaaagtcaaaatcatttgcagcaaagcttgtttctgtaatagttgtggattcagaagtagtcttatttggacatatgatattcagcaggacttttaaagtccttttgctattttacatagttcaataaggttttttgtgagagtatgatgttattaatatggactgtattaatgtgaggctaagagttatatgtaatatccctttgcctatttatcttacatcaaaatggtatttatatcttaatgagcaaccatatcctcctgcagatatagatctttgagattccattattcgctcttccttatttagggtttcagttagggaatgtccagattcagaactcaagtccccactgaattccatataccatgctctaatgagtctgttagagaaacactgggaagataataggatatactacctttattcttaccagtaaatcacctccccaggtaactgttcttacaataaaactaccagctgggtggcaagtctctagaccaagataaggttgtattttagccctcttgtgcattcagtacatatcttaaaaatcataagaaagatgaaaaataaaataaactcctgctgaataaaggataatagaaagaaaaataagaaaataatttgagaaaattctttgtaacacacctctggcattgcagttaatgctataaaaggcctttgtttctttaagaaaatgaatttatcacaccagttactgataatccaatctctgcccaactggataactgcccaaccaactttcttcatttgataattatttgtaaaatatcccctttcaaaaatgtatagaaatgtctatgtcaggacttcccaaaatggttccctttgttgcaatattttccttactgccgccataacctcatagcctctaagtccttttgccaagaaccaaaggagagaagagaaagggataaaaatgggtttaaaagtaggattagagtggcaaatgagagaaaaattagtaaaataaataaataggagtgccataaattttggagaatgctctggaatcatttttcaataaccctgtgactggggtcctgagcccacttataagctcaacagacctggtctcttattgcgagaaacccatttgtgacctcaggcaggatagactaaagaagctctggctccatgatctgtgactgagcatgaaatcaacctaatggtcctgtggttttgtattcaggtatcttcactctgtctccaatcccaatgtctgccttcatcacatccctgatactgggacccttatgttgaactgcatgctttagaccctcagaaacagggtactccctcattctgcctacatgcttacctccaaggactcataaagttctgcttttcactgttatctgctcatagattttccatcgacatgttatgaattctacctccaggaccatctaattcactgttctgccaacatcctcagccaatcaatagccttaacaagtgctagttgacaggagctagatttttccagaaaggctggaattctgtctcatgtctaatcccattccatacctgcatcccgtttcctgaattccagttcttaccccatttcagactggcccatttcattgttattacgtcagaacatgtcctgagatacaccattttccttactcagtgtgaagcaacagaattaaatgcaaggcttacatttctcagaatataaatggagaaaagcttttttttcttcagtccatcaaactccaaatcaatcctgaggccaatttgtttgtctttattagaaaaatggtactgttttaaagggagagattttgattgactgattgatttaccagtctcaaactaatgttgagttgtaaatagcaatggcatttctaagaactgtgctgtatcttcaaacatgaggtgatggatgtctgtggagtttcatcacaccaggagagctgtcacaccacttgcttcattctatatgctctactggtttgctagttaacagttatacaatatatatttgctcactctccatgcaaacagataaagactaacaattaggagctcattattatttgggaaaaaatccttagcaactcagcaatatacactttaaaacaaactggtatccaaaagatgaatgatgctctcactctttctcagtagtaatgccctctttctttgagtatgtgattcagtttcaaaatatcactagcctactaactctttatgctaaaagaaaaagtctagtattagagaagaaaaacaatgaaaaaatgaagtttcatgattacttttgttaaactcttacgtaattattttcttatctgcaaagcaagagtgaatgtcagttgcaggaaaaaaaaaatgtgtccaaaactttctccaaccttaacaattcatcagggccaatgtacccgagaactagagaccaacagcccaaacagataggagtgagtaaagttattactatcatacttgtcagactgaatcttttgtctatagcttctgtcatccccaaatctttgtaacttcaactccctgaatccctatgggtttaatctgacttacttttagaaccatccctaactaagtcagctgtcatgcacagaaccagaggaaaagatcctaggaggaaggcccaggaaatgcaaattctctgaggtagtggagtgctttgcagatttgaggacaggaaggaggttactctccctggaggctggagttcaaggttacgtgagatgtgtgctaggcagaataacagccctccagagatgctcatgtctgcaggaatctttaaattcataccaaaaggactgtgcagatgtgactaatggtatagacacaaagagagaaaattaccctgggttatatagagggcccattttgatcatgggagttcttaaaagtggagacgcttcccaggctgtggtcagagaaagatgtgactatagaagagtggtcagagaggcaacagcctgaagtgtataagatggcttattgctggttctgagctgtagtggcccatgtgcaaggactagataaaggcctcaagaagctgagagtggcctggatgtcacccagcaaggaaataaagacatcagtcccacaaccacttggaactgaattctgtaaacactttaagagtaaggaaacagattctcccctggaacctccagaaaggaagccagccctcctgacacattgattctagcctagtgatgtccatgctgaacttctgacataccgaactatgagaaaataaatgtgtgttgttttaagccactaggttgtggtaatttgttatagcaacaagatacacctagatgactaagctatacaggtaccagatcatgcaggcctttcaggtcatggtagtttttcattttttttttttaagcaatggggaaaaaataacaaatattaaggaggaaaatgattttcctaaaagattactgtggaaaagatgcttcacaacctcatagagaaatgcaaattaaaacaagataccactacacacctattagaatggttaaaatccaaaacactataacaccaaatgctggcaaggatatgaaacaacaggaactctcattcattgctgctggggatacaaaatggtacagccactttggagaacagtttgacactttaacgaaattatacatactctcaccatacaatccagctactgcgatccttggtatttgccccaaaggagttgaaaacttatgtctacactaaaacctacacacggatgtgtatagcaacttcatttatacttgccaaaatctggaagcaaccaagctgtccttcacttagcaaatagataaataaactggggtatatccagacaatggaatattattcagtgctaaatgaaatgagctatccagccatgaaaagacatggaagaaacttaaatgcatattactaagtgaaagaaggcaacctgaaaaggcttcatactgtatgattccaactataacgttcttggaaatacaaaattatgaaggcagtaaaactataaatacatccagcagatgccagagcttgggtaggagagagggatgaataggtgggacacagaagattcttagagcagtaacactactcggtatgatactgtaatggtagatacatgtcattgtaaatttgtccaaacccacagagtgtacaacaccaggagttactactaatgtaaactgtgggctctgggtgatatgtcaatataggttcagcaattgtaacaagtgtaccactctggtagggatgttggcaatgggggaggctgtgcctatgtgagtgcagtgtgtatgtggtaaatctatcttccattcgattttgctgtgaacttataattaatctaaaaaataaagtctattaaaaaaagaaaaaaagatgaccgtggctcctaagtggattgtatgtgtagggtagcaggtacttgcaagaataagaaacagcaagattggagctgaattttagaggcagaactataagattttatgatgcataaggtatgaaataagtgaacgagagggagaaatcaaaaagggcttttgtgtttttggcttgagaagaagaaaagctgagagagatggggaagatcaggggaaccacagaccttttttttttttttttttgagacagagtcttgctctgtccccaaggctggagtgcagtggtgcaatattggctcactgcagcccctgcctccggggttccagcgattctcctgcctcagcctcccaagtagttgggattacaggctcacgccaccacgcccagctaatttttgtatttttagtagaaatggggtttcaccatgttggctaggctggtcttgaactcctgacctcaagtgatccacccgccttggcttcccaaagtgctgggattacaggcatgagccaccgcacccggccggaaccacagatttaagtgataatttggaaagcaaaatttccattttggacatgtaaggtttgaaacaacctttagacatctcagtggagatgcagaatagatagataaatgaataaatctggagctcagggttgaaggcttggcagttaatataaacttgagaatcatcaacctacaggtggtttcaggctcatggaacggaataatattacctaagtagagaagtatgcaagtgaacgtaggaaaagaggagaggctctgaggcattcaaagatttcagaatcaaaaaaaaaaaaatagtagcaaagaaggaggagaacatgaaaacatttcttttaagtgcatgatggctaggagggcaagaaaggagagtggttcaacagagaaagtaggcaattgtattgatactggtgagagatggggtaagattaaggcaaagcaggacagtagatttggtagcatggagatcttcaacaagaacaatttgaagggtgcaatgggagtaaaaagagattgaagtgggttgaagagtgaatggtgtatgaggaattagcattgatggataccgacaaaacatcaaaaaggttagtatagaaagaacggagatgagcagttgtggtttaaggaaggtccaagagaaggctttagattattctctttttaagaagaaagattttgaaaaatcttggtgaactattaggaatgatttagtagggagagagagaatggtgatgcagggacgatgccaccactgaaggactgaagtaaagccctttgaaggagtcaaggtgtgaaattcagagcacagagagaaggagcaggggcaggataagagccatttgtgtgccccacccacctcaattctagaagagacctctggccagtccccaggctcatctccaacctaaggtatagttcatattaaaactccaacccttcccctcccatcttttcctcatggacttgtgagtggaagtattaccatatctccaatccaaatcttaggaccagataagaataattctggtaagctatttaccccactgtaatcagtatttctatttgagcttttatttcaattgtgcatcaaagatgttaatatagagaccattatgtagaaacaaatatattttactttatttttacatattaaggtgaatcatacagcttggaagacattgaaaagatgaagggaaattgaaagaaatgcaggttaggcatttccgtagaaatcagtctaagtcaatttaagttcatgatgagggtctgatagctctcataaagcaactctcactatggaaggcctcattcaaagaaagtcaaacttttacacaaatttctaaaacagaattttgaaggatattttgattatatcattcatcatttttaatcacattctgaaaaacttcaaactttgtcttcactgtaaggataatcagtcaatttgttttatcctaaaaaaactagccatttcccttgtagatgtcataagctgcttctgtaccttttccatgatttcattttattttcttgtatgtagatttcagagaaagttctcactttctgaaacagtgaaagcaagaaagaaagagagggaaagataagttggaaacgagagaatgagagagactttttaaaactacggaatgttttacaaatgtagagtgtgattgtatgtatataaagcttagcctaagtcaccactcaaataaagaagttaccattcctgtaccattcctgtctgggctagaaatctcttaatgcctattttctgaaatttaacaaatcaaggaatcacaaggcaccataagttcagataagggaaaaaacactagactggatatctagaagccgcattttagtctgccattgccaaacatgtaaccttgtgcaaatcactttacctgtcttatttatactgatctatggttttgcctattgtataataatcactaaataaaaaaccaaaacaaaaatgttaaaattattaaaattttagacacttattctgaaaacagaaataaccataattcctttacatcttttatttaaaagctgagaacccctatataagaaaggagaaggaaagctttaagtacaatggcaactaaaatggcggcacaaacaaaacgaaattgcctccaaaacactgaacttttaattacggacgatgtcaaaatgcaatgtgttcctttagcttcattattttgaatctgtttcttgtttcccaataaactgaataaataaacagtgatttttaaaattaattatgtagtgcaatttccctcccggaaaaccaatatagcttaattttcattaactatattgtaaatcgcattactcttttggaaaacgttcaaggatgcttttatttataaaccaatagatgagaactataatgcatttatagtaagtctggacacttttacagggggcttcctatttgaaataaccaagaagtagaattcaacaatgatatttttccttctaaactttttaaagtgaaaaaatccaatatattcttgaagtcagaaatagtggcatccagggttaaacttcagcattcatgatgctaattagctagccatgactgtatgtataatgaagatattaagctttctctaagaacactgcaacttgaaattcaaataactaacgttatggaataattgtgaaatatgatcaactgatttaaacactacgaaaatgtagcacaattccctttcaagaggaagaacaagtatattctatagacaaatgccaaaatcagaattagcacatagtcaagaaagaaggtgactaagagtacactggtaaccattttgaataaatcactttaaaactagtcacagtgtgaatgagcataattatatggctctcaactctgctcatgtttttctctttcacttgcaaatcccctcaactgtcatgtttagttgtctctttgagatgttactatacatggtaacagatgaatctgctcttctgtgagttttatatttataaatgatcttagctcacgaagccatggcattaaatttacattagaaaaggtttgacccttgggtccgtgcatgcagttctctgttgcagaaaagcattacaaagctctctatagggagatctgaaaagacatcaaaaatattttgaaatgcagaaagcagccaagatgccctataccttttcattgcttgcactgattaaccgcttacataaaagaataactaaataaactaacaagtgatccccagagagaagctgtcttaacaagaatgtttaattttggccctctgagttcttctagaaggatctaaataattatgtgtaatgtctctaacaaccagagaattgccaataaaagaaattcaataaactcagtctaaagcatagattaaggtacaaactttctaggggagacaggccaagagaatattgtaaacaacagaatttcaaaaaaaaaaaaacccatttaattacagtgacttgcacttactagctacttatgagtgttgatgacaaagactaagaaaagtaagatttacaagataagattagagaattgtttactctgtccagcaaatcaatggggggaaaatatgagggaaacctaatgtactcaaattcaatgcaagatgaatcttttcagtactgaatgaaatactcaaattattctggctacatactaagtccttttgatttgtcgtggatactacctaaaagaacacagataatcaagactgagtccaaggaagtccttctgccagaggtcagcagaaaaagtttacaagttctttgcaatagcagcacaatttttctcatccttatgttttttgtatctaatgctgtaagaaaagcaataggtgtttaatatatgtatttttaaaattctctgaatcaactggtatcatctacaaatttatttttggagaataaatcataacagaaagaaaaaagttattgcatgttaccttaaatcatgtgtctaacaaaatatatacaaataaaacaaaaatattaattaggtgtttatccatgaatttattagatggtgtcacatgttctcaaaacaacttcagaagtaatttatacacgttaatttttataattaaaaaaaagaaagctgagttgcagagatggttaataacttgagcagagttttacaggtaaaggagtttgaacagaactcatgacagggaacaataccggaaaccatattctatccactttatcactctaaagtctatccagaaccctgattttctgtttctttaagttgcttgttcttatgtcttcttatataagcctttattttacaagcttccctctctcttcctttctcttaaatatgtcaaaatgttacaaaatatctgactcaagcttgtttcttcattgagaagattttaaaagttatctaaaagacaaaagaaagaacttaaagatataaaataagggcaacttaatatagtataaacaaaatatttttgtaaccggatgttaaaaaaataataaaacattttagtataggagtctatatacttactgaaaaattaattttcttattcctcatatttgtgtgaatgtatattttaattaagacatttgcaattatatttctgataatacgtatcactgattacattgtagattttttcaaagcacaacaagctcaacaaagaaaggaaagacatagaactatgcagtttgggctttatttatgcataattaaaaccaattagctgtggcaccaaatcaaaaaatcttgtttcccttgaagcaagtctttgtagatactaatactgtaatttatgtgtatatatagtaggcgtttcatttgcaagaagtttagaaaatgatcagagcattttcaatattgaaaaatgaagaaattcacaataaattatatatatttatatataattgtgccattggcgagagctatagagaaaaagtgaaacaaataaacaaaaaaaaaaaaaaaaaagaaagtgtcctacttggaaatgtagcccctgaagaagatgcatcctcaattccatctttcacttctctagagcatagaagggtctagaactaaatataatcctttcggagtgacctctggttacattgggtctcaaagtcccaaaagctatgccccaattctcacactttattgtgtgagacaggaggcatgaattgcagtctttttgttacaaaccagctgtgtcactatatcttgcaagactgcaggtacctcatccgtcaaacattgggtatcaatggatcttcaaccaatgcctttaagagtactcaaacttttatgaagtagatcaaaaatggattatcagtaaaatcaagaaagatttgttcattaagcgggaaaatgttaatattaaaaatttcttaatataaaatgttctttcacatattatcttcacctttattatctttcagcttctttctttcttttatattccaggagagagacatggtatgctattacaattaacagcacccaccctggagtcagactgcctacatgtgaatccctaccattcaccacctataattgatacagtccatttctttatgcctcagttttcctcgtttataaaatgaggataatacaagtgcttctttataaagaagccaggaggattaatggaagtaatacacataaagcactagaacagtacagacctaagcatcacataaacaatagttgggccaggcatggtggctcacgcctataatcccagcactttgggaggccaaggtgggaggataacctgaggtcagaagttcgagaccagcctgaccaacatggagaaaacctgtctctacaaaaaaaaaaaaaaaaaaaaagaacacacagaattagctgggcatggtggcacatgcctgtaatccaagctacttgggaggctaaggcaggagaattgcttgaacccaggaggtggaggttgtggtgagccgagattgcgccattgcactccagcctgggcaacaagagttaaacttcatctcaaaaaaatataaaataaaataaaataaaatagttgccataaacaatgcatacaataggaacaagtttagcacaagatctgatatttattctaaaattcaaaggtaaatactgcatggtgctccacaaagagtgccatgactttcttgtgccttacaactgaatatatccttccttctaggcctaaatagctataactctgttatttaagtaggctaatggactctataaaacagaattcatattttgtttctttcatatttctagattacataacaagtttagggggtgtggttagccagatgatggataattgggccacagctttgtttgtttttgtttatttacactaataatgatattttattaaaggctgcaaattttatggtgtatccaacaggctgtgttctgatatttaagaacctgactgacagtaacatggactacagatcatttcttaaataatgctggtaaataactgaatgaagagtggtttttataaaacctaactcctgcctaaaaggttcctttttttccctttctgggccagtgagaatcttccaggccacacccatagtacaaggacttcaccagtcacggccttcctcatctgtttctctagcctcctcttgctagcgtccatgctctcatttcatcatccatgggacttcttgtatgcctttccctcttcctgaaccttcctgtttctacctttaacctggttaacttctgaccattctgtaggagtcggctcaaggcctctcagtcttgagttttgtgttccttgttgcgctcctgcagtagcaccccatgctcacctccattagtccttaccattgaggagcaatccttgctttaagtgaattctctgctactgcatctgaagctccattctgacagaagctgtggtgtattaatcttagtatccaagaacatcacccctacttttattgagttctcagcaaaagtttattgaatgaatgaatgagattacccatcctgaatcctgataggtctcatgcttaaaatgtctgctttgtgtgaaaaaaatgagaaatattactaaatattgttataatatattattcctatgaaaataagcaaagtgtttaagcatatacagtatgctaccttttatatatataggaaaatataaagatgtgtgtgtgtatgtgtgtacatatatatattttaaaccaaaaattaataaaagtggggatatccatgggaagaaaagggacaaagtaaagcaaacaagataagttacacttctccaaatgtgctttactttgaggttttgactttggaaacatgaaaatgtttcaaataattattaaacaaaattaattcaaagtaaaacagtaattcataaaaattaaaagaaaatttaaaaagggaatataactgtgtatggattggtagtttaaccaacaacaaattattttaaaaggcaaaaaccaataacttgattgtatactcctggtgggtattttctaaggacaatgaaaaatgcaaggaaatcttaaatcatttttattcatcaaattgttaataatatgagttactcttagaatactattaaattgttgcatatatagaatcatataaaactaacacttttagtttaagagaaaagagataaacatatgaattaaaattgaaaacaaaaacctataaactcaaacttaaattagaagtataaaaatatcaacataaacatgcaaaatatttctctttcaaaacttctcttcagaaaagacctagaaacagtgactaagtgagaaatgaacatttccagtacctggactgtggatacaaaaggaaccaaggtgccttattgatatggttatgtcctggtcaggtcagaaaatataagagaagaggctaatttgtcctaccagaaagtgaaaatgtgctaatgactagtggaatcatatcaaaaggactcaggagcaaaagtgaaagaattcctattggcaaatgagataaactgaacatcataaggaacaataactgcaatggattgaaaaataccaaatatcacaaaatctatgcagtcataatgacatttaaaaacaactcaatggtcatatctacggaattttagagaaccaatcacttatcattagagagagtagcttgcattatttctgccttctctgtacaaaatgtgactcaatataaatacacacataatatagtaaggttgttctttgtagaatcagggatttcagaataaaaatcctaaaattcatatggaactacaaagtatctgtaaagctaaagcaattttgagagagaagaacaaagattgaggcatcatatttcctgacttcaaaatatactacaaagctacaatagtcaaaacagtatggtgctggcaacaaacaagcaaacaaacaaaaaacagacagaccaatggaacagaatagagcatccagaaataataccacacacatatacttaacatgagtgccaaaaaatacacaatgaggaaagatagcatcttcaacaaataatgttgaggaaactggatatccacatgcaaagaacaaaactggatccttacctcacactaacttaccacacactagacacaaaaatcaactcaaaatagattacagatttacatgtaaaatctggcaatgtaaaactcctagaagaaaatataatgggaaagtttcatgacactgagcttggcaatggggcaatgatctcttggatatgataccagaagctcatgcaacaaaagcaaaattagatgactgggactacatcaggcttaaaagcttctgcactgcaaagaaaacaataaacagaatgaaaaggtaatctatggaatgagagaaaatatttacaaatcacatatctgataagagattaatatccaaaatatatgaggaacccctacaattcaacagcagaaaactaaattatccaattaaaaatgggcaaaggacttcaatagacatttcttcaaagaacacataaacatggcaaacaggttatatcaaacagtaacttcactaactataagggaaatgcaaatcaaaattatgagttatcgccacacacctgctaggatggctattatagaaaaatacaacaacaactcaaatgtcagcaaagatatggagaacctggaacctttgtccactgttaatgagaatgtaaaatgacacagcttttgtggaaaacagtatggagtttcctcaaaaaataaaaacagaattaccacatgaccaagcaatcccacttctgggaatatattcaaaagaactgaaatcaagatggtcgtttccaagatggccaaataggaacagctccggtcggaagctcctagcaagatcgacgcagacctgcatttccaactgaggtacctagttcatctcattgggactggttggacagtgggtgcagcccacggagggtgagccaaagtagggcggggcattgcctcacccaggaagtgcaagggttcggaggatttcccttttctagacaagggaagccatgacagactgtaccgggaaaaacggtacacttccccccaaatactgtgcttttcaatggtcttagcaaccggcagaccaggcgattccctcccatgtctggctcagcaggtaccacgcccatagagccttgctcactgctagcacagcagtctgagatcaacctgccaggctgcagcctggcagggggagaagcatctgccactgctgaggcttgagtaggtaaacaaagcagccaggaagctcaaactgagcggagcccaccgcagctcaacaaggcctactgcctctatagactccacctttgtgggcagggcatagctcaacaaaaggcagcagacaacttcagacttaaaggcccctgtgtgacagctctgaagagagcaggggttctcccagcacagtgtttgagctctgagaacaaacagacggccccctcaagtggatccctgactctgtgtagcctgactgggaggcacctcccagtaggggccgacagacaactcatgcaagtggctgcccctctgggacaaagcttccagaggaaggatcaggcagtaatattttctgttctgcaatacttgctgttctgcagcctccactggtgaaacccaggcaaaaggggctggagtggacctccagcaaactccaacagacctgcagctgaggggcctgactgttacaaggaaaactaacaaacagaaaggaatagcatcaacatcaacaaaaaggacatccccaataaaaccccatctgcaggtcaccaatgtcaaagaccaaaggtagataaaaccacaaagatggggagaaaccagaacagaaaagcagaaaatttcaaaaaaacagagtgcctcttctcccccagaggatcacagctcctcgccagcaatggaagaaagctggacggagaatgactttgacaagttgacagaagtaggcttcagaaagtcggtaataacaaacttctctgagctaaaagagcatgttctaacccatgggaaggattagaaaaaaaaccttgaaaaaaggttagatgaatggctaactagaataaacagtgtagagaagaccttcaatggcctgatggagctgaaaaccatggcatgagaacttcatgacacaggcacaagcttcagtagccaattcgatcaagtggaagaagggatatcagtgattgaagatcaaattaatgaaataaagcaagaagacaagattagagaaaaaagagtaaaaagaaatgaacaaagtctccaagaaatatgggactatgtgaaaagaccaaatctacatctgattggtgtacctgaaagtgacacggagaatggaaccaaattagaaaacactcttcaggatattatgcaggagaacttccccagtctagcaaagcaggccaacattcacattcaggaaatacagagaacaccacaaagatactcctcgagaagagcaactgcaagacacatacttgtcagattcaccaaggttgaaataaaagaaaaaatgttaagggcagccagagagaaaggtcgggttacccacaaaaggaagcccatcaaactaacagcggatctctcagcagaaactctacaagccagaagagagtgggggccaatattcaacatttaaagaaaagaattttcaacacagaatttcatatcaagacaaactaccattcataagtgaaggggaaataaaatcgtttacagataagcaaatgctgagagattttgtcaccaccaggtctgccttacaagagctcctgaaggaagcactaaacatggaaaggaacaactggtaccagccactgcaaaaacatgccaaattctaaagaccatagatgctatgaagaaaccacatcaattaacaggtaaaataaccagctaacatcataatgacaggatcaaattcacacataacaaaattaaccttaaatgtaaatgggttaaatgccctaattaaaagacacagactggcaaattggataaagagtcaagacccatcagtgtgctgtattcaggagacccacctcatgtgcagagacacacataggctcaaaataaagggatggaggaagatctaccaagcaaatggaaagccaaaaaaaagcaggggttgcaatcctagtctctgataaaacagactttaaaccaacaaagatcaaaagagacaaagaaggccattacataatggtaaagggatcaattcaacaagaagagctaactatgctaaatatgtatgcacccaatacaggagcacccagattcataaagcaagtctgtagagacctacaaagagacttagactcccacacaataataatgagagactttaacacaccactgtcaatattagacagatcaatgagacagaaggctaacaaggatattcatggtttgaactcagctctgtacccccaagcggacctattagacatctacagaactctccaccccaaatcaacacaatatacattcttctcagcaccacattgcacttattataaaactgaccacatgattggaagtaaaacactcctcagcaaatgtaaaagaacagaaatcacaacaaactgtctctcagaccacagtgcaatcaaattagaactcagggttaagaaactcactcaaaaccacacagctacatggaaactgagcaacctgctcctgaatgactactgggtaaataacgaaatgaaggcagaaataaagatgttctttaaaaccagtgagaacaaagacacaatgtaccagaattttgggacatatttaaagcagtatgtagatggaaatttatagcactaaatgcccacaagagaaagcaagaaagatacaaaatcgacaccctaacatcacaattaaaagaaccagagaagcaagagcaaacaaattcaaaagctagcagaaggctaaaaataactaagatcagagcagaactgaaggagatagagacacaaaaaaacacttcaaaaaatcaatgaatccaggagctggttttttgaaaagatcaacaaaattgatagaccactagcaagacaaataaagaagaaaagagagaagaatcaaatagatgcaatacaaaacgataaaatggatatcaccaccgatcccacagaaatacaaactaccagagaatactataacacctctatgcaaataaactagaaaatctagaagaaatggataaattgctggacacatacaccctcccaagactaaactaggaagaagttaaatctctgaatagaccaataagaggttctgaaattgtggcaataattaatagcataccaacgaaaaaagtccaggaccagacagattcacagatgaattctacccgaagtacaaagaggagctgataccattccttctgaaactattccaatcaatagaaaaagagggaatcctccctaacccattttatgaggccagcatcatactgataccaaagcctggcagacacacaacaaaaaaagagaattttagaccaatatccctgaagaacaccgatgcaaaaatcctcaataaaatactggcaaaccgaatccagcagcacatcaaaaagcttatccaccatgatcaagtcagcttcatccctgagattcaaggctggttcaacatacacaaatcagtaaacataatccatcacataaacagaaccaacgacaaaaaacatacaattatctgaatagatgcagaaaaggccttcgacaaaattcaatagcccttcctgctaaaaactctcaataaactaggtattgatggaatgtatctcagaataataggagctatttatgacaaacccacagccaatatcataccgaatggacaaaaactggaagcattccctttgaaaaccggcataagaaaaggatgccctctctcaccactcctattcaacatagtgttggaagttctggccaggacaattaggcaagagaacgaaataaagggtattcagttaggaaaagaggaagtcaaattgtccctgtttgcagatgacatgattatatatttagaaaacccccttgtctcagcccaaaatatccttaagctgataagcaacttcagcaaagtctcaggatacaaaatcaatgtgcaaaaatcacaagcattcccatacaccaataacagaccaacagagagccaaatcatgagtgaactctcattcacaattgctacaaagagaataaaatacctaggaatccaacttacaagggatgtgaaggacctcttcaaggagaactacaaaccactgctcaattaaataaaacaggacacaaacaaatggaagaacattccatgctcatggataggaagaatttacatcatgaaaatggccgtactgcccaaggtaatttatagattcaaagtcgtcctcaccaagctaccaatgactttcttcacagaattggaaaaaactactgtaaagttcatatagaaccaaaaaggagcctgcatagccaagataatcctaagcaaaaagaacaaggtatcacactacctgacttcaaactatactacaaggcaacagtaaccaaaacagcatggtactggtaccaaaacagatatatagaccaatggaacagaacagaggcctgagaaataacacatccacagccatctgatctttgacaaacctaacaaaaacaagaaatggggaaaggattccctatttaattaatggtgctgggaaaactggctagccatatgtagaaagctgaaactggatcccttccttacatcttatacaaaaattaattcaagatggattaaagacttaaatgtaagacctaaaaccccaaaaaccctagaagaaaacccaggcaataccattcaggacataggcatgggcaaagacttcatgactaaaacaccaaaaacaatggcaacaaaagccaaaatagacaaatgggatcaagttaaactaatgaccttctgcacagcaaaagaaaccatcatcagagcgaacagacaagctacagaatgggagaaaaattttacaatctacccatctgacaaagggcttatatccagaatctacaaagagctcaaacaaatttacaagaaaaaaacaaacaaccccatcaaaaagtgggcaaaggatatgaacagacacttctcaaaagaagacatttatgcagcagccaacacacacttgaaaagatgctcatcatcactggtcatcagataaatgcaaatcaaaaccacaatgagataccatctcatgccaattagaatggtgatcattaaaaagtcaggaaacaacagatgctggagaggatgtggagaaataggaacgcttttacaccgttgatgggagtgtaagttatttcaaccattatggacgacagtgtggcaattcctcaaggatctagaagtagaaatgccatttgacccagccatcccattactgggtatatacccaaaggattataaatcatgctactataaagacacatgcacacgtgtgtttattgtgacactattctcaatagcaaagacttggaaccaacccaaatgtccatcaataatagattggattaagaaaacgtggcacatatacaccatggaatactatgacgccataagaaagatgagtgcatgtcctttgcagggacatcgatgatgctggaaaccatcattctcagcaaactatcacaaggacagaaaaccaaacaccacatgttctcactcataggtgggaattgaacaataagaacacatggacacagggcagggaacatcacactctggggcctattgggggttggaggactggggaagggatagcattaggcgaaataccgaatgtaaatgacgagttgatgggtgcagcaagccaacatgccacatgtatgccaatgtaacaaacctacatgttgtacacatgtgccctagaacttaaagcataatttttaaaaaattgaaatcaagatcttgaagagatatctgccctcccatgttaattgcagcaatattcgtaatagtcaagatataacaagcacctaattgcccattgatcatgactagataaagaaaaacatggtatatacacataatggtggagtagtgtttggcctaaaaacagaaggaaattttgctacatgcattacgctaagtgaaataagccagtcatggaaggacaaatacataatttcacttacatgaggtatctaaaatagtcaaattcacagagagtaaatggtggttgccaggcattgggtgaggaggaaagagaaaattgctttttaatagctataaagattcatttataaaagataaataaatcctacagatctgtgtacaacattgtgcctatagttaataatactgttttgtgcacttaaaattttgttaagaagtagatctcatgttaagggttcttaccataataaaaatattttaataaaaactttagaattccagctaataaatgaaaaaggaataacagaatattactattttacaatctctgttgaacaaatagatctatgtaataatcatcagtgactactaaagcattagatgaatagttgacagggaacttgataatgggtgaatcaggccaaccacacttaaatctaaggatcaatcttaacaccataacgaagagatattagatattatgggcttcctgatagaatgcagtagaaggaactcagcatcttgaatgaagtattcttgccaaaacatcaaacctggatctgatcaaaactctatgcctagaaatagcttacaggaagcaaaggatcagaggaaaattttaagccatatcatggagatgcattcaacaacatccaaaagtgggaaattctacaggacaaataacccagtttctttaacaaatagaatacaagtggaaaatagaagagaaagtctatcttcaaaagtatcttcaaaggtccacttcagagtgtcttttggtagtctgcaccagtctttcaagtttaaaggaattgtagacttatattaatctacaattaatttttcgatacaatatgaggaactacttttgatcctgtttcaaaaattgacagtgtgtgtgtgtgtttgtgtttgtgtgtgcatattgaatttggtgttgactggtatttgattcgaagtcatcaaatttttgctaactttttaaagtagaatgatagcattatagcatttttttttagtgcgtctcttttagagttacactgagatgaattatatgatgtttgagatttgcttcaagatgatccatgagggtggggtataactgggagtataagtaaataaactctggctttatgctagtaactgctgacactgagcctgagcgacacatacagggaagtccattaattattctcttgacttttgtgtatgtttggaaatttacataacataatgctaaacaataaaaaacattaaaatatagaattagatacaaaaaaatcctactgaggttttgatcaggctgcattgaatttatacactgattaatttaagctattgattctttcaattcaaaaatgtatctctgttcattctgtccctcaataacatttctcttgtcattagcattgccactttcatttctattttctaggtataaactgtgcacatttcttaagcttactcagaggtaagttataatttgtgagatttttttcaatttcactaatttgtaagtctttttgtgttttagtaacaataagcagtttgaaaacaaatatgaagcaattgcttttgtatacttactttgtaattttcctagttgttatactctttttctggtactaataacttttcacttgagcctcttagatatttcaggtagacaatccataatctacaaataaatacttctttttctcctctctttgaaaaatatgtgctgacaactgtattgaaagggttgatatcctttcagttgcttcctgaaatccttattttgagaggatttccatcttaaagcaaagaaaaacttgtattatgttcctgccagacttctagctctcaatatcccatgttaggaactttcagatttatatacctgatgagtttgcgcaatgatttaagttttctattcactctaccatcaattatagttcagagaacatcatcaatatcaagtagttgggaatatctaccccaacagatatcaaaacatatgtgccactaccactggaagattagataagtgaaggcttccttgattcttattttcaagctgatgaaataaggtaattaaattaaaagaaacccagactgtcccttgtcataaagcaaatatggtgaaggctatcataggaactgaccaaaaaaattaaagccaatctcaaaacatccatatgaattttcttaacatgagggatgtattttgtagagaagttacattatgatttcagaagacattatcttggcttcactacacatagcacatctgggaattgtctacttgaaagtcttggctagaagttctatttgatggcctcaaattaattctgatattgaaaagtctaaaggaagttagtacatgccacatgccaggctacttggcataactgagtaagacacctaattttccagtgggaaaagaccaaaagagttggaccaggacttcacattgatcttgttatgagatgaaaactttgccctttagtatactgcttctcacagtgacatcaagtctttcacttctacctcaagcctctgggatgacaatgtgactccatgccagtttcttgtagcatacaggctgccagacacaattatttctgacaacaggctcacatttctttcagtcaagttagggtatttgtggacaaggatctcatcaaagctgtcaccattgcatttcacctgctttaccgaatgtttagaatgaaaggctggtgcagactaccaaagacactatgaagtggtttttcatcgtccaatatgttatggatgttctctaagaagtcctggtcatgctgaatactacttaggttaagtttcctaacttgtgtcaaccatctctatcgagcataaactgagaacttataaaatgaataagagtattctagctgctgctatggctagattaatcattgtttttttttaaaaaaattcatttttattatagtagttttgctttgctggcacttaattcaggtttttcccctgtaagttgagtctggatagtgccatttttatggagtcacaaagcaccctgtgcttttttcatgctagcactccctacacacattgtaacaagtgtttatgatatgccagattagattgtaaacgccacaagtgtggaaatgtatcttttctcttaattcttcagcacctagaatgggaagtagcacatggtagacatatgaggaccagattacaaacagtcatttaaatgaggcttcttcaagctggattttaaagccagccttcttgacacggtattgttggcaagtttttatttatttatttaggctacaggtatttccagtaaggtcctcattgaaagcccacttaagctaggagccacttgcgataatactagaggtaagaaacaggaagagtaaacagctccaaataaggaattgtccccaaattgcccctgtacatgttgacaaacaccccaaatcaggagtaaatacaagatcactaccagccgggcgcggtggctcattcctgtattccctgcaatttaggaggccaaggcagatggatcacctgaggctgggagttcgagaccagccaacacagagaaaccccatctctactaaaaatacaaaaattagcagggcatggtggcacatgcctgtaatcccatctactcaggaggttgatgcaggagaattgcttgaacccagaggtggaggttgtggtgagccaagattgcaccattacactccagcctgggcaacaagaccaaaactccatctcaaaataaataaataaataaataaataaataaatcactaccttcggacacaaatgaaatttccttcagaacaggaaatttcctccaaccaattactcagattggaagcaaataagagagcaataaaaatccatctgcaacacttgttagtcaaatagagaccaaatggtgaaaaatacaccagtactctggttaattggcccaaattttgagtgagtttcatgcttagtacatactttccgcttgcacttatcacatcttgggtaacagatttgtgaatcaactacaggtattcccagagaaccataattatgataatgatatagccattaggagtagctacttctgcatcatcttaatgttttcttttcaacacacatatattgagtatccattatctgttaaaagtagaattcagagatgaatgaaacaccacaatccctgaatttaaagaatattctatggggaaaagggcaaataaacaatttaatactatgcatttatatggcatatataaatggtttataaaagtgcttatgaggaagtcaccaaaatccctagaaaatgtttatgaagattataatgttttagatacatcttatagaagatttcaccagataaaaactaaaggaagactattccaataagagagagtagcataaacagtgatttaaagtcagctagaaaatggcttgttcggggaataataaataataaatacttacagtgtggctgtattgcaggtatgcatagcatcttggttagtaagtgcaagtaatgacaaaagggtagatttaagccagatggtaaataatctttgtatcaagttgaattctttgtccttcatggcctcgcttaaagcatctgccaagtcttatacaatatgactctaccaactttatcactacccttaaccatcacttctgctggaaacttagggtgatcaccttttcctagaatagccaactcataagccagatagcaacctataagatggcatggaaaaaaaatcagaattttattctctagaattttaaacagaaaactatcaaaagaatgaactgattttcagtacaactaagacagtcacaaggtagcatgtaggcattgaagataacatgtaaagccaactccatggcgagcaaaaaccatgaataagctagagctgtgaggcagaacagaggtgaacacaagacaggtgacgtggagaaaagcaaagtggcagagcactgaaatgaagctatggatgcctctccagtttggtttccgctcttcttgaaaaccaattgtttgcctttaacaaaaatataaacaaaatgacaaccttgtgcgtcatgacaatgagtcgctatttaaccagaggtcacagtgagctattcatgggatttaaagaagacagcaacgtaagcaattttagatagtatattgggaaagtagtaagaccattctgaagttgccctttgagccattccactgaggcctaaccaaatttcaaacaagaaggaagcaataattcttttgtttaccttgttacttgaaggggaataactttctacttaaaatattatgctagccatgtggaagatagattatgtgtgctagaatattagtaatttctttccttttcagagccaattatgcacgtttcagttacttaagggaaagtctgtataattcaacattaataaagaccgttctatacatttccaacagtaggaggaacttaaaagaattgttttgcccatggcaaagaatgccatgcattaaattcaagttaataaaaaatttgtatagttcccaatattagtaaggattacttttggatggcgagatcatggttcatgttttataataaatatatatcactattataatgcaaagaaaacaaacttagagaataattgaagacttgtttgtttcctttctatttaacaaaacagattttaagtcctagtggtctagttaaatctatatgaggttaggaaaaaagttatataaagtgtcaactactgtttttcacattgtacaaaaacattgatttgacttcaaagaagacagaatgattataagaaatagactaatctcaaaggatctaggctctactcaaagtcttgtatctgtgtcgtatattaattgaaccagttacttcatctctctggtctacatttttaaatctgtaaaatgtgaattggacaaaataatctcaaaatcccaattacgtgagtctcttaagcctttatgtcactactacttggtattactacaatattttccaagtttaacttgcaaagcttgtaagccacttgaaattatgtaaaacctctcaagtcgtttagaactacccacagaaaatatataaagcctaagaatcaggactaatggcctgaacatataatgacatgtttaactgttttggtttctctaggcagaagcctagagtatttcaaaaggaaaacacaatgattgaaaattgaatacactaaatcaaaaatattttcatgactttaactaaatagaaaaagtctggcctcaaatatagccaatgaagagaagaaattttacattactattaccagattttgcatacaggcccatactgcatcatcagaagattacagatttggattatacataagtggttgcctatttgaagtttaaatttacttgtaaacctctacttcctagagttgtaaacacacactcaccctcacacaccacaccaccaccagaaccatacacatatgtatcaaattcaggttttctagttttttactataaaataacaaatacaaatttgaaaatagcaaagtattccaaagcataaatgataataattaaaaacaaaatcttgatacaaaaaagtaggaaaatgaatacagataccaatagggtatagtttgtttcttttaaaagtttacataaaattctattctatttcattaaaaattaaaagttcttttttttagaagaaacattgggctcaggaaaattaaacacctgtaagatattgaaaacatttaagtttgcaaagttataataaatacaaagtataagatgccaaagcaaatttagtgtgcatgaacacaacaccaggaagagtcatcctatttccaccaaatacattccctcaatatctatagtaagatataacccccaagaacggtagtaaaaaatattttttcctagcatttttggaggctgctgggcttgctgatattagcaggttggtctaggctaaaaggaggatgtgggagaaacctcatcaaagtgatgattcaaaattcataaataaatgaacacacgggggaacattttaatcactcccacagtagagtaaatgaaataatggcagacacccttaacgaactatacagccaaggaagccacaagtaaatacaatatatccaagcttcttccaatttaaaagttgtattaagaaatgcgtacataggccgggcgcggtggctcatgcctgtaatcccagcactttgggaggccgaggcgggcggatcacgaggtcaggagatcgagaccatcttggttaacacggtgaaaccccgtctctactaaaaatacaaaaaattagccgggcgctgtggcaggcgcctgtagtcccagctactcgggaggctgaggcaggagaatggcgtgaacccgggaggcggagcttgcagtgagccgagatcgcgccactgcagtccggcctgggcgaaagagcgagactccgtctcaaaaaaaaaaaaaaaaaaaaaaaaaaagaaaaagaaaaaagaaatgagtacatagtaagagaccttaaaatgacactagtgcaaaatacattggaggatatggataacaaaggaggacagcatctcacttttacaaagatcttcagctcccattttcaaccttgggctacagtcttaattcatacggcatccttccagtatcatctgccatgcctgaaatctgtcatgagaaatccatatctgaaacacggcagattgatcgcatgcttttattgtctctttcacgtcaaaactcaagcaatgacaaatgaatacaaatgaggatagagaaaagaggaatgaatgaacaatttctacaaatttttggagaacagaatacatggtagagtcaaggcagctacagtctaagtgcttactgaagggggaccttatgtcgcgccataaaagtcatgagaagcaccagaagtaggggtcacaaaaaagatggggactgatcttcatagagcgagatcaactgccagatttcggtctttaccccaagcaatcaaaagactaccccatccctctaacagaaaagagtttattttctggcaaattcaaacctgaaaagctacactgaagtatactaggcatagcagtgagacttgggactgacaacctaagactaaaatgagaatgtacatgttgaacttggggcacccagcaccctttccctgccttgcccccagaacactggtagcaggtgtacatcttccatgtaggagcggttggcagtcttctctgggtgtgtggggagtggagtctaaatacatgtacctgaagcaagctctctgtctaatcttgctaacacaaaatccaccaccaaaaccttgcccactggcagggtgccttcttttttttttttttttttgagacagagtctcactctgtcccccaggctggagtgcagtggcacgatctcggctcactgcaaactctgcctcccaggttgacgccattctcctgcctcagcctccccagtagctgggactacaggcacctgctaccacggccggagaattttttgtatttttagtagagacagggtttcaccatgttacccaggatggtctcgatctcctgacctcatgatctgccctccggcagggtactttctatcagtttttagtgattcactcattaatatgaatgaacacagaagaatcttaaccgtagagaaacgcctccaacatgaaatgggccaacacgaactggctaaattacctcagaagaagtagtggcaccgcagcaagcagtataccaccaaaaaaaaaaaaaaaactgcaaataatatcctcacagtgagaaaaaatggcacatccatgagagtaacagtatgctatgaagaaggggcaaaaagataacttaaaaagagctcatggagctaaccaatatgatcacctaaattaggatgggagttgggggatcagcaaactgtttctgtaaaaggccacgtagtaaatattctaagttgcaggatttgccatctctcaactctgccattgtagcttgaagacaaccatagacaatgcataaaagaatgcacatgaatgtttctttatttacaaaaacttaattttatttatattgcttgacccagtggtatcattgctggatttgattgtgccataatcttctgacatctggccaaaatttgtaataaataaataaaagattggatcataaagcatagacattactctgtaggatggaaagagataaagagatggaaaataggaaagaaaaaccaaaggatcaatccaggaaatccaaaatttgtccaatagaagtttcagagaaagagaacaaagaaaaatgtggagagatcattttttgaaacatacaatacatttgtatagaactgaaggacacgtctccatatttaaaaagctcactgactgcccaaaaactaacgaaaaaaaaaaaaaagcacgaaccaaagtatatctgtaaacaatttccgaataccaggagggaagaaagtatcatacagaggaaaaaaatagatcatacacaaagaaataagaatcagaatattgtctgattctctacagtgacagtggtatgggaagacagtaattcaatgtctcaaagattctgagggaaaattatttaccacccagaattatattacagcaatctatcaatcagtaatactggactaaaaaacttagacatgaaatttttatttcacatgcaccctttcctaaaaatctattagtggaaggtgcttcaacaaaatgagtggtaaactaagaaaataaatacatggaatccaggaaatagggatcctgttctggaaaatggtgaagtactaggtacatagctagaattggatattggagccaagaaatggagtgctgcaggcaaataggattatctgaaatgcctgagtgtttggaaagcttcggcatttgacatatatatatatataatatatatatatacacacacacacatatatacatatatacattttttttttttttttagatggagcctcgctctgtagccaggctggagtgccgtggtgcaatcttagctcactgcaacctctgcctcccgagttcaagcgattctcctgcctcagcatcctgagtagctgggactacaggcgcctgccaccacgcccagataattgttgtatttttagtagagatgggatttcaccatgttggccaggatggtctcaatctcttgacctggtgatctgctcaccttggcctcccaaagtgggctgggattacaggtttgaactactgtgcccagtccttgacatatatttttaaatgttgggacaaacaacaagccctagatacagacaaaaaagcaaatgtaaaagaggtagagagagaaagaaaataggaacaatccttaaactgcaagaaaagcaaaacgctgaatgagaatggcaacacagtctagtacaccacttaattcatcagtgtctttgtttacacagtgattgtgagtcatatcgcctatttatttaatactgtaataataacatattaacatgggaagcagggagagtaaatgatactgaatcctcagttaaaatagcaagaaattaaaatatcaacaaaattcaaaaatattataagaattaaacagtagctaaaataaaatgattgcacctaaaaagagtaattggtaagaaattgagagggaagagcaaggatgaatgtttttaatacaggccttttctcctatttgctttttaagctacagtatgtgcataaaatgcagttctctgtgcttccttaatactttccatttctcagactcacctattaaatttcaagaatcctgagaaagctaatactataagccattatcagctaataccataggattcatttgttgataagtggaaaaatgtccaaaaagaactgggtcaccacaggcacctggagacaaagtggaaatgaaagaaaatcagtaaggaagaggtaaggaggtgctggggggaaattgaattgcaggacactcagttgatgtccagagagttggagaattggttggtatggaaaaactccacaccctggtgtcagaagtgtggagtatataaaaaaacaattttcttttcctttttaatggtggccaatgaaaacccaaaaggagattacatctaaggtgacaggattatgtgagttgctccctacttgctctccaacgtcaacaactcagaaagggatttttctggccacagtatcaaatggtcattgccctcatccttgttagtcttcttcacagcacttattactagttgacattgcagtgtgtagctatttttattttttaccatctcatcaacaagaatgcaagaagtcctccagtggaaggcactttgtcttattcactactgtatccccagcacgaagaacagtgtaagagtttaataaatactcattgaataaacaagttaattttatttttattaaggatctgtggcatttgctacccgggactaagtaaatttttgctcgagttacaatattggcacatgggggctctgctgttagttgcaagagtatcctaagcattccccaacattcttaagggaactgttcaactgggaatggccacagctacagctaccaagtactaacagtataaggaaggatcctctggtttgacatataggctgatatattttagagtaatataaggacccacagactcctgttctctgctacttcattgcaaactatgcagggattctcatttgtcagaagtttaatatctttcagatctgggccctaaaataaaaacgtttttaaatcagacattgtttcagaaacaaaaataaaaccaacctatggcatagctgtttctttatcaaaatcaagattgtctattatctttctcctcctggtgactggggaatttaattcctaatgctgatataattgccaggaagtcgaattttaaaacacaccagtgtatccagttgaaactattatatacagtgctttaaaaatacaatatgaaattttcttcaaaaactcttgtcacatcagaatacatgtgaagtggatatagcaaaatgttatgataccatttaaagaacactgactgactttacattcaaagcacagtcatagatgcaaagtaaaacatcaaatattaaggtataaatttggttaagaggtttttatagtccctctaaaagtcttttctccactgtgagaaaatacaggaaatttaggaatatatataaaactagacgttttacaatgtgactctggtgccacatgtttcttgatggaatttgttctgaaagaaaagctagaaaactgatttctctcagcttaagtgactacaaatgaattttgattgctatcctattaataagaattttttgtgcctcagttagatgaacacttcaatggcaatacaaaaattagcagatttatttagcaagtaccaacaacaaataattgctgttgctaagggtaaaaaggcaattgtgatgggatgtgaagaacagaaatcctggtgatatgaatgttaaccaataaagttctcaaacttgccatttagcgcattcctgaattctctgatggcataaataccacaaagtagaagtacaactttactctaagctctaagtcctgtattactcaaaagttcttcaaatcttaaactgctaccaagaatgaatagatgccccaaatatccactttggggctggatattctgctcaaattaatgaatagactcttgttaaacatatatgccatgaaaactgactatgtgcaagttaaagcctacaatgggaaaaccaccaaatgcagaacatggaaaaagctaaagtccaaatgacgtggcatccaacacatcaatggcattacaaaatgaaagagacttcaaatacatcaaaaacaaatgcaatgtgtgggctttttctaagatcttgatacgaacaaacctacttgaagaacttgttaattttattaggtataataatgctagatggttaaattaaaaggctgttaggaatgcatcctgaaatgtgcatgtgtgtagatagataaatagagagagagagagaggttataaagacatatgttggctgggtgcggtggctcatgcctgtaatcccagcactttgggaggctgaggcgggcagatcacaaggtcaggagattgagaccatcctggctaacacggtgaaaccctgtctctactaaaaatacaaaaaattagccgggcgtggtggcaggcacctgtagtcccagctacctgggaggctgaggcccaagaatcacttcaacccgggaggcagaggttgctgtgagccgggatcgtgccactgaactccagcctgggtgacagagcgagactctgtcttaaaaaaaaaaaaaaaaaaaaagacatatgttgaagatttgcttttaaaatactccagaaagaaaaaaatattgcacttatgtgggaagaggtgtgagtatcgacgaaataaaattagcaaaatagtaataatttttggagttgatatttattatactagcctctcaacttttgcgtatgctttacctttcctactgaaaggaagaaaaaaaagtatttccttgaagtcatatagtcttttcagccttcataagtctgccactgaagtttatagtgttggctagatttctgtattcccatatttaccttaggactacctttgcaggaagtgacagtgaggaatgcaataaaacctgagaatatggattgacgctgctgcataaatgtatcttcaggtgaatgggagggagacatgttggataaccttgcaatgtctcattcattaaatttgtcttttcccagaaagacactgagagaccattttaatggtcagacctggaatattctttattcatttatctaagtcagagatattcactcataaccatatgtgaccagacagggtttttaatggagcccttaaagcaagcagatggaaatcaaggatatttcagggaagtgttaatgctctgatgaagatctggatataattacaaatgtagacatgcatatgagtattctaactagaaatgaagaaaattattttcacagctgtaggaaactctatattggcattctgacaaccctgatatattgttgggtcacaaacattaaactctttacaaaagctaaatcaaatgcgtctattggtgaaagtactttataagcgaatacacagaatatcaatggtgtattctgtataataaatggttgtggtattaaaattagtagaaaagaaatactgaggaatgtttcctataatattagtaaattctggcatgtccttggtcatgttcatgacccttgataacccttaatatatgctcatggccacagaacctatacagaatcaagggaaaattaattttgtcatagatactctgattgcagaaatatctgtaacactttataaatattgtacaatgtacttactcataaatcatgaaaatggttcctaagtaaaaatccttaaaagtttataagtcaggttttataagtcccattttgcagatgagcaaactgagacccaaagaagtttgcacagaatcagttccaaattccaaatgtcaactgacatatgcaataaacagtacatgtgttgagtccaaatgtttccttacctagtctttatgcaatctcgcatttagattttcatcaaatcttttggctctactgccctccaaggccatatgcaaagatgttgcctctgtctagttcatttgaatggaaatccatttgctattgtttgggggctaattttgcaaatcatttcataactttctgttcaaaaactacctttaaaatatttaaaaatatatcatggtgctttgaggcttaagattaagaaatattttcaagaactaaagtctcataaaaatgaaggaaagcaagagccaaatccagatttaatccaaatgtgttaaactcttggtcttgctcacaaaatgtgacccacgaaaacagttatggcttcaccatccctagggttgcttagccaataaaaatgaaccatctttactttccctctttatttcatacctccacttctatttccttagaaaagttctgttgattttattgtaaatatatcccgaatctaaccaatgctcaccacttccactgctaacaccctggcccaaacaccatcatctatctcctggattgatatggtggcctcgttactgtgtcccctgctaagagtgatcatctcagtcagtctgtgcttctataaacaaaaatactatatcctgggtggtttaaacagtaagcatttatttctcacagttctaatggctgggaagtccaaaatgaaggtaacagaagacctgatgtcaaagacagcctgatttctggcttcttaatagctgccttctcttgtagcagagagagagaagaagcaagctctctcatttctgtctctttttatccttataatcccactgatctgtcatgagggctccaataccatgacctaattacctcacaaatgctctatctccaaataccatcacattgggaattggggtttcaatatatggcttttggggacggtaaatgagaacatccgatccacagcagtgatccttttaataggttatttgatcacatactaactctgcacaaaaatctccagttagctccccgttttctccataataaagccagtattcttagaatgtcatccaaagccctccatgacctccatctccaattattctatcacttggtctctccattctagactcattggcctccttgttgttcatggaacacatgatctgcttccacattaggcctttgcactggccactccccatatatacatttaagtctcacaagctcatatccttcaaggtttgctcaggccagtttcttaatggccctaaccatcctatttaaaactcagcccacctcataccttgcactcccaatcttccttatatttttcttttttttcatagtacatatgacctactaatatactgtatatgtttatttttaattgtctgtcttatccctttagaatgtaatcttcacaagggtacaggcctttattttgcacacagatgtattcccagtgtctggaacagtgtttagcacacaatggttattcaaattaaatatttgtaaaataaataaaatatctgaagtcaacaactgttaagatatcagtccattctctttcagttatgaatttctaagtttatatctggcaactcagtttcatattggactaaaatttggcagtattgccaaactgagatttgatttatttacccaatttaaacaaaatatgtttagctatttgaagtcctataagcacaataaaataaaaagtctttagatacatgacactatttttataattgtataaatcattaaggccctggatgcattggggatatttaactcgtcaggtagtttacggtttgttctgtatgcgatattaagtgcaaaagaagttgctagtttctaaatacataatgcaatataattttgcttctgctgaaaggcaaatcagaaataatcagctcgctatagtcgacaagtaaaaggagaaaaaacttttaaaaagtatacaggcaaattactaaaatcttttagaacacagtcttttctttttctcttgagggactactctatgtctttgcagtaacttctgcagcctcaagtattcagtgtggcttagaatcacattattttgttttggatttctcaactagcctcatggataatcttccctcttcaaacaatttattatcctgaaccagatcagacctggttgtgatgccgacttaaggggtcgtgccaaagtaggggccatacacagttcctggaggctgactcagtccaagagtggctactgattactgttgagaaagagattgatggtcagtatttttttccttaatattatttcattatgaacatttttccttgtcaatcaatacattgctaccaaagcaatttttgttgtagcacatcattcctgtcatatagttttgttttatttttattttattttttatttttgtgggtacatagtaagtgtgcatgtttatggggtacatgagatgttttgatataggcatgcaatgtgtaataatcacataagggtaagtgtggtatccatgcccttaagcatttacgctttgtataaaaaacaatccaattatacttttagttatttttaaatgcacaattaattcattattgactatagtcaccccattgtgctagccaatactaggtcttatttactcactctaatattttataccctcagttgttagtattaagactaaataaatattaatcataagatccaaagggtaggtgtaaagtcagaactatgcagtaagataagatcaggaaccaagataaaagaaaaatgtctgaaaactaagagcaatgtgtgtaacacagcagagaataatattcaccgtaaataattcaagaagatttatcccaggaaaagcaaagtgagagcccacattctcagtgggttcctctgttcttctgtcaatgggaagtaaagtatgatgagcaagaagcacaaagttaatgggtcctccagcctcctggagtggctctctgcagctcttgggcaaaacagatgtctcaatgactacgtgggagagtgaggggaaaactcagagcctttcaagcaacagaggtgtgagagagaagttatcaatataattctcattagtctgtttttgagagatacaagttgtcaagcccatttgggatattaaatgataagggttcagtattacccttctgtgctgtgcaaaggagaatagtcaaaagcatatttactgttctcatgaaatttgtagtttaactatgaagacaagatatctgtgaaaagtaaagatcactttctgatcaactaagttttctcactttctagtttttgtctttgtatatacctcctttaagaatactttctccaaaattgtttccagtctcactgactgaggaaattttcaggactcaatcccatgtacaaatgttgaacattacataatcagttatactatatccattgtacttgtgactgatataaaaacatatttttttcaatagctatttattgcatgtctgcaatgtgccaagtgctgttgtagatattaggaaaaatgaagtagacaaaacattgtctttgtccttgtggaacttacatctcagtattataagtgtgcaaaccctctcttcctactaggagaaaatattatttttaatcattccttcacagtgagtttcttaaacttatttcatcagagactattgaaaagcacacactcttccatccccctagaatgagaatcctgggggagggattgggcagtctatctttttaagaaactcactggatgtttcatgtgcattcacagcttaggtaactctgggggaaagcactgccctattaagaacatactgcccaaggaattggtaatatccattgtactatatctgtaggaccccttttgattgtcattactagcctttatcaaacatctcatccttggagaatgtgaaagctctccacggttttccacagacagttcacctaacaaaaaacaacaaggcaaactttttcaagaataccattatttttaaataaaatgcctctacatggcagatgttattatgttctactttggagatgaaaagaatcgaacattattagtcatgatccacagaaccagaagatttattttaaagataaagttcagatgatgaacataaaggaagttatctcatcaaagaaggcaagactgagtaaatctcagaaatccaccatgtacaatatttaaaaatgctcactaaagttgttctttgtgagttaatgaaggtcagtatagtcaatattcagtacgtaatcctagcaagtacaaataaagttaatattattcaaatatcttacacaggcttattgcatgcaacacactgttctaagtaacatacagatattaaaatgacttaattctcaaaacatgaagtgagtttttgtttttatgcccgttttgcagatgagaaaactgaggcatagggaaggtaagtaacgcgcttaaggttacatagctggtaaattgtagccaggagttggaatctaggtgccaaaatctatgctgttaatcactaaactacgctgccttagtttttatacttctttaggaacctcagaccaaaagaaatttaggcaattctaatagaacaagcaagaatttgctaatcacagcttccttgccccaatcctttaatcggcttcattttcactgacttcttttttaaatgaagataacaatgttgttgaacaggatcatctagtggttagtggttcggcataagaatgactcgcttctgaagctcagctctagcactcgcttgctgtatgaccttgagaaagttacctccccaagtctgtttcctcatctttaaaagagaggttataataggacccacatcatactattgtttaaagagaaaacaacgtagcccatttaaagcacttagaaagtgctccataaatattattagtgtaataaatagcagcaacatcaataaagtatgaaccaaatgatctcttgattcgtatcctaacactaaaaatggtttatttcccttctaattaaaagagaattacaacaaccaaaacaacaaacgaaactatagccataaaatcaattatatcgtctgtgagaaaaccggaaaggctattggacacattaattcacttgtcatcagtcatcccctctattccaaaatgtttgtgttctaacatcctgagacaccttgcataatataatcactgtgactccaagaggtcaaatgggcaggcagttaatgcttctctgtgaaaagctcaataattcattttataaatttcagtttaaagcctgcgttgaggttaagaaaaattgacgttcggtctgtgaacttaatgtcaagctccagaaaaactctgggcagcacatgtttagcaattaagtggacacagacaataaagacgttgccaaattgtaaaacaagacttggaaatcacagaaaatgttgctagttattgatcacggtgaccattcagttcctactgagccacccaaaagaatcattcattttccagcagagagcctgctcatttgcaagataaaagagagacatttctgcacatgcccataatgttcttcaccactgggggcagctttacataagactgcattcactgaaaccaaagcaacagtccgagcagctttcagaatgacagtctgcagaagtgagctgagcgtgtgcgcggtacggggctctcctgccttctgggctccaacgcagctctgtggctgaactgggtgctcatcacgggaactgctggggtatggaatacagatgtggcagctcaggtagccccaaattgcctggaagaatacatcatgtttttcgataagaagaaattgtaggatccagttttttttttaaccgccccctccccaccccccaaaaaactgtaaagatgcaaaaacgtaatatccatgaagatcctattacctaggaagattttgatgttttgctgcgaatgcggtgttgggatttatttgttcttggagtgttctgcgtggctggcaaagaataatgttccaaaatcggtccatctcccaaggggtccaatttttcttcctgggtgtcagcgagccctgactcactacagtgcagctgacaggggctgtcatgcaactggcccctaagccaaagcaaaagacctaaggacgacctttgaacaatacaaaggatgggtatgttttgtcatttttcttctttccttcttaaaaacaaaaaacaaaaaacctctagtgtgtgtaataattctgccttaattattttagagattaccttgctctgctctaagactatgaatttatttgcttagtggcatgtttccttgtttaactatttaaaaaaacaaaacactaaagacaattctctttaattacaaagagataatatgtgatgttaagtgttatttagatttaaatttttaaaaatgaaaaatatatgcctatttttgcttgattaaggattaattcttttttggggggataacttttctaagttgtttttatttccaggtttcaatgtaattaggctactgagcggatcagctgtagcactggttatagcccccactgtcttactgacaatgctttcttctgccgaacgaggatgccctaagggctgtaggtgtgaaggcaaaatggtatattgtgaatctcagaaattacaggagataccctcaagtatatctgctggttgcttaggtttgtcccttcgctataacagccttcaaaaacttaagtataatcaatttaaagggctcaaccagctcacctggctataccttgaccataaccatatcagcaatattgacgaaaatgcttttaatggaatacgcagactcaaagagctgattcttagttccaatagaatctcctattttcttaacaataccttcagacctgtgacaaatttacggaacttggatctgtcctataatcagctgcattctctgggatctgaacagtttcggggcttgcggaagctgctgagtttacatttacggtctaactccctgagaaccatccctgtgcgaatattccaagactgccgcaacctggaacttttggacctgggatataaccggatccgaagtttagccaggaatgtctttgctggcatgatcagactcaaagaacttcacctggagcacaatcaattttccaagctcaacctggccctttttccaaggttggtcagccttcagaacctttacttgcagtggaataaaatcagtgtcataggacagaccatgtcctggacctggagctccttacaaaggcttgatttatcaggcaatgagatcgaagctttcagtggacccagtgttttccagtgtgtcccgaatctgcagcgcctcaacctggattccaacaagctcacatttattggtcaagagattttggattcttggatatccctcaatgacatcagtcttgctgggaatatatgggaatgcagcagaaatatttgctcccttgtaaactggctgaaaagttttaaaggtctaagggagaatacaattatctgtgccagtcccaaagagctgcaaggagtaaatgtgatcgatgcagtgaagaactacagcatctgtggcaaaagtactacagagaggtttgatctggccagggctctcccaaagccgacgtttaagcccaagctccccaggccgaagcatgagagcaaaccccctttgcccccgacggtgggagccacagagcccggcccagagaccgatgctgacgccgagcacatctctttccataaaatcatcgcgggcagcgtggcgcttttcctgtccgtgctcgtcatcctgctggttatctacgtgtcatggaagcggtaccctgcgagcatgaagcagctgcagcagcgctccctcatgcgaaggcacaggaaaaagaaaagacagtccctaaagcaaatgactcccagcacccaggaattttatgtagattataaacccaccaacacggagaccagcgagatgctgctgaatgggacgggaccctgcacctataacaaatcgggctccagggagtgtgaggtatgaaccattgtgataaaaagagctcttaaaagctgggaaataagtggtgctttattgaactctggtgactatcaagggaacgcgatgccccccctccccttccctctccctctcactttgctggcaagatccttccttgtccgttttagtgcattcataatactggtcattttcctctcatacataatcaacccattgaaatttaaataccacaatcaatgtgaagcttgaactccggtttaatataatacctattgtataagaccctttactgattccattaatgtcgcatttgttttaagataaaacttctttcataagtaatcccccacattcgctgttagcctcctggtgggaccaaatctacagttatagaaggtttgcacctcactggcaaatcaaggaaagaggtgaatgattccaggtgctcggagcttgagctgattcttggagatgactcagttatgggaacattttacagacaggcagagcctttaaaccaatgcctgacttagaaaagaaaattgcaggaaactatcaaaagatggtgctaggttaaagcagcaccctgagcagtttccagaggtgtctgaattacagtaaggcaagcacagggacaaagtgatgaagggttaaaatactgcaagcagacaactgcaaaatgtgaggagatgacaaaaatgtaaagttttcgactcagccttgtctctgaaacccatctctgtaaaatcagactagaggtttcactgccaatttcttctagcctgtatgtttcataaataaataaatgaaacagcattgagaagccagatttctccaccacacctcacattagttagggagttttcagataaggttcgcgaatgggaaagcagcttgctacaggcatgtggttgagagcttaccagaatttctctttccagttttttcgaagaccctaatgtagttagtagaatccttagctctgtcctgttctgttcagaatttgtcaggctgccctgttgtgttccattacatgtcctgcacacaccagtcccctaatgacagacacttcattcagatgtgtaaagagaacacattccaagacgtgccttccacccacagcctcattgaaaaggacgactttgataacaccttaataaatgtataaaacgaatcttagaggaaaaaagaccaacactatgacagttctctgttgcttttctattgctgacattacaatgtccctgcgttcatctgtattgtgaactcatccatcagtacagttctgtacagaccctgttggcaatctgcaagctgcatgcatgtttttatgtcattggtgaaagtttattgactgcagcacgaatatcatagcttccatatttgagtaacttgaaccacagtcaattaaggtttttagaaagatatatttagtctgtattctccttcatcctccaaaatgaacagttctattatagaagcaaatatcaggaactgcaacattgaggctgtttcatttaatttggcttgccaacccctacatctttaaccatgtccctcttctctgaaaacagaatcactgcagcaacaaagaaaaagtgaatggctatttttactaatttttttttattgtttgggggtttttcatatgctgagaggaaaaatctaggcaagtcaccataaaataaaattttaaggatgccagatcattaaaatcatacttttataagcaataaagaaaaagaaatagttaaagtggatttctcaaggtactttgatattgattaaatcttacaatagatgccacttcagaaaaacatcttagttacaatgtttacccatgaataattgttgaatatacatgtattcatgacaaaaagtcacatatttccaatggattaataatgcagatacttcctcacagcttactggatgactgagcttattgtgatttttttactgaagttgtaactttacatttttcataaagcatcagtaaatacatattccatcttaaaaagaaattttctttggctagcctcatttttatctgtactaaagatgtttgtattaatgaaatgcagtcttaaagtgaagaaccccatttctattctttttcacttaaccttctgccttacttgtgatggataccaaatatatttaggcaaggaatacttatatttttgaattattgcaaattctcaatgccatggtgctactagtatatataaaatatgcttgctgtattgaaaagcattcctaaaattcaaagctacttggaatataaaatatgatataacactaaatgaatcaccaatattttgaaagctgtcactttttaatgcctaactttactaataaacataataatagataagaacgaaaataaaatcccttaggtggtaaaactcattttgatttgggacatgaaattatgggaaaaaagttctttctttctcctcactctttgagaatgaatcttctgtaattctcagtatcttctgagcacagatatataattcttgtagatttaataactagtttaccactgtaaattttaaaacgccaactgccagtctcctgctcaaaagttgttgcctcacctccatcccatggtactttctggactacatatcataaatctatttgtataagtatttcaagttcatgcagattagagaaatgtgattgatatttatttttctagtacgtatttacataaaatattggacttccctcaaaggtgacaacagttaaaaaaaaaaaaaaaaaaagcctgacctgttgaactatacaacagaacacagaatactttgctttaccaaaacagagaagaaatgggatttagtctctaaacttcatgtgagtttttttccatttttattaaccccagtacacatagtgctaccacagcatgtagttaaatagtcccagtgccacagtcttgtaagcaatacttatgcaagatatattgcattgaaatgagtttgtattttccaaggacgttgacattacatcttttcaaagaatttaaacaattttttacttgatttggtgagtgaactacctaagtagacaggcagtaaattgtctttctatggagcagcagtgacctctagtgtctggttagactaaccacagctattcacacattttagctttttatcctgaatccttatgtaaacgtggtttacaacatgttttttgactagtaaatcagatttgaattttatttaattcatttccttgggaaatataattataatgtaatttttgaatgttatacttttcattttgacttttatagtaatgctggaacagaggccatagaattggtactgaaggctagaaataagtgtccaagatgaaaagcgagtaataacgcaataagaatagataagaaatattttagagtgcttatactcatcgatgctggctaagcattttgatatttttattaaaggggttaatatttttcatcagcaagatacatgtaatttaggtaggaaaaacaaattttaatattatatcaaaagagtcagcatcagtcatttactggtcagggatatgtcaaaggtgtcaaaggaggggggcctccccttccggctttagaactctccagtttgctgattgtgccagtgacctgtgctttgcctcagcgctttctccctccctcccccttttcagccagctgaacactggttctattaggctctctgacaatgatgttacagtctaagaggtgatgattcatggataatgaaattatgctctccttctggggaaggataatgcagagtcagattcatggatttggcaagaggttttaggatgctgtaggtgcatgaaatatctcttcttcccttgacatttaccaaaatgagaactcaaatcgtttatttaaagtgtggattagactgcatcagaaacaagcatcaggtcatgaagcctgagataaagtgagttccagacatggcaagtaagaatcgagccatgagaaataaaaaattcagaatctgtgttgcttcatctattcctttttgctctggattctcattagaatccagatctgtagctaacccacggagttttgctattgttgtattctcctagctacctacactaaaaatcagaggcagttgggggaaacaatgagcacaacagaatatataggtaaatttgaatgacacaagttttaagagaaataaaatggatggatgttaaatagtttgtatcaaatagctctaattaaaaatgaattaaagaaataataataatacataggtgaaagtcactgctttcctaatcataatagcctacagaattggacccaaattcttttagcctccaaaagttggtgatgattttggatacttaatactaccaataaaatctaaataacaataatttatgattcttttgcatttgagggaaatatcacagccaggcatggtagaatacgggccttagaaattaagacctaaattcaagttcctttgacacttgctaatcaagtcatcacaggtacatttcctggcttttctgaatttgaagtttctcatatgtaacacagatgtgtactattgactgctcatggtaattgggaggacgaaatgtgaaaagtactttgtaaactctaaaatggcaactacctcttcttttcaaaaagcccttagtgagatactgagtggggtttgttgttctatgtttggcatgagccaaaaagaaatcagtaacctccatgttacagaaccccaagcccattttacatcattagaagtctagaacatcgtctttgactttctgttttcacataggcacagcttcttccacctcatgttatctaagtctatgatttttatactgattatcacaatgtacaacagacataaagacaccgaccagcgaacactaaaacaaataattatcaaacacattgaaaattctacttgtatttcagatcaggcaactatagcaagggctttcaatcaggacgtttacctgtccactccctttctagtatcattgtgttcaatccttgttgactttacactggatcaatataatgtttatatggcaacatgacatcattattgagcaaaaagtaattgcatataacatgttactgtaggattagcacgcattccaggtatcagtcacatgatatctgctctgatgtttctcccctggccactccagtggaagactgtgcccaagatctcctcttagtatagaaattactattgactttatcaattataattattgaaaaatcactggataaaaaggggtataaatgtacagggacttccttttatatgtcattgcttatgcaaaattacatcattaattcatcaaagaatgacaaaaggcttcctccgctggatgtagctgctcttaccaatatgaagtagcaggtgtattttcaaaatgtttgtcatttaagaagacacagactgttcctctttgacagctgagttcctatggcatatctaaagatcagagagaggatgatggtttttcaggtggggaagcagttgtgagttttctgacattttaacttcatagggtcatgaatggacgctcttgagttagggatcctgaacacgtgaggaaaattccaggaacacagagagaacaggaatatctgggacatgatataagaccaagcaagtacaatgtattttacaattatactttctaacaacagaacttctataagcaataataatccattttattgaaaaaaaagaaaaacagcttctatcttatcctttccagcaaatgttgtaatgataattaataactttattaacaattctccatgttttctttttatttttaagggctctcacttctcccaatcaggattctcatttatcctttctctcactcttaaattgttctccttatttgaaagagtctgtaattcctatatcaccaaaaaatgtcttcctttataaaccaacacaattcagtcatttggctcaaaagagcagcattatctccaaaagaaaagttacacacttgcattaaatattaggacataaaacaaatttaaagctggctgacacttctctttcctctacaatctataaaacacctctacagtatattatgatttgcaattgaaaaaacaggatatatagttgaattacagtcttacaaagtattaaagcttactgttttcctccttaattagctaattcctagaaaacaaagtataggactttatgtataggggtactcaactatatttcaccaatcagaaacactctttccaacaatcagaattttgtcttctcaagggtaaaatatagtttttttggcctggcatataaaatagtaaggcaaatactacatttagcaaaggcaatttttgttgacatttcatcacatcaattacatctatgcagggtggaaaatacattttgtcagtaaggaggcaatgacttcaattaaatgtaaatccttagtcagcattcttggtgctaaagcttattaatgaagtgggagcagaatgaaaatgtcatcagacagtgaagctacagtatcatgaggctatgctaccttgagtggtgttcatagcttcaactgggtggccctcatgtagctaaaaaagtgctccttgtcattaatattgatctatgtactttctaaaagaaagaatatgcttaccaacagagccctcatattgactgtcttcctataagtttccctcattaatatttgatgcagtcaaccagaatctcacaagagctttaaaggaaacttgtagaatgcatcatgttgatattgaaaaagtagagtagcttttaaaattctgataaatgtgtgacaagattacaacagtgaaacctctctaaggtacaacagtgaaaatagttataacggtgaaaactctaggaagtttaccatagtgaaaactctccaagaagtttaaaattcagcgctttgagattagtgttggcatgtacttgtcaatttatgaaagggattttgcctaatgtattcaaaattttaatgtgaaaggtataaatacttggtttgtgtactggcaccaatagagggttaggtaacatcactgaattatgattaaaatggaatatttaaagatctttctaatatggcagaggacatattacatacgtatttgtatttccaccaaggtacgtatgttgtacatgcctaaaaaaatatatatatattttcctattaggtgaatatttttcctataatgtgaagatattttggtataattgagtccttattatgtaccaggaatttgtatatattatctaatgatttgataaaaagtgttttatgcgtttcgtaaactcagatagttttccttaaaatataagaacagagccctttatattgagtctgtcttcctgtaagtttcactcattaatcctatacattttcacttctttataggactgctctaaaataatttataccccacccacaaaaggcttctcaaagccaaatcatgcatctccagatccctttaggaaataatttccgatgatttaccattagaacatccctctgctagttaaagtctaatctgccagtatagtgttccttccagcctgtggcacccactccagcctatctcatgtcattcattaaaaagcagtaagtgtttagtcttttggacttttacagggaggactaagtaataaaatgtaaaaatctacatatatttttatgggctttactctggtcacttttatggtctaacacacacagatgtgtggagtctttattagtttacactaaaatgcaagagcattaagctagatatagacgaaaagagaaagtcaaagtagatttcaaaatagccaaaagctcacattatacgtttcttaatgttaaaaaaaaaatcccaaatgatggagatcctgtaattcactttcttgaaagctaatttaccctcctctaagtttgccatcacattcttaaatttaagctgacattccttctattttcctatttctaataggttttcctggtgtttttttgtttgtttgttttttggttgttctgttttgtttctctgttgttttctgcctgcagatcttaattctttgagtgcactgccttgcctgtttttctagaattcccaatcaaatgttgatcctgtcagaaagtcacagggtcagtttcatggttggagtcatcggacagatggactagattgaactctacagcgcaatctagtcaactctgagatgtctgccttgtgtcttctcagcatcccatttccatgtattttctctatttggaagtagtatccatattgaaattcctccatccagtggtgcccagagctttcttggtttcttatgcgttatcaaatatctgctcccagagtgagagcaggattactgtcccttccaagggcactcacctttaaatagagatgaaagtcttcagctaaaggtaagaaagttatatattaagagcaggcatagccagcagggttggggaaagttcttcttaggcaaagacctttgtaaagcactctgaaatcatcctctatagattcctcagtatttttctcaaacatgagtttgggcctttccaaaggagccaaggcagggtaaataatccatgtttcattcaataaactatatttgagaatttttttttcagtgaatcgccattatacaaagtctttctccttaaatttttttcatggagagacaactttgtataccagaaagaacttggactatggatccagtttgaattctgtttctgggattttagtaactgtgaaaccttgagtctcaacatcgtcatcctaataaaaatgtgtaaaacaatgtagttatcatgggattgttgcaagaaggcaaagaatcagcatttgttaaatatttttcctggtacatttcatatataatctaatactcataaagatcctatgaagattcaatgagatgatgtagataaaatcatttaatacaaaggttggcacataatactttctccttcccttcattagttccaactgctaaaaatctcagtaccacaatgcgctttgaaagtcatattacactacctatttttattttgaataacagactcctggtggactttccggaaatagaatctaaatttccataagctcaagggcatctgggcacgtagttaatactgaagagtgatggtagtacataaaaccaatgtcctcagcctcccaacaaagcccagctacaaccacctttattgccctaccctttcccatgctctaccactggcaggttctcaaagtagcccatgcttcccaatctctgtgcttttgatcaagcaatttcctttgtgagaaatgcccttcctccctcccaagtcctccagtcaatttctgagcttttccagaatagatcaaattctgctcactccagatgtcttattaatcttttccttccctcttttctgttttttttccccctctcccagagactgcatcacagtctaccttatgttagagttattaaggggtttgtatcacgatttgaggaaatggataatctcttcttttccttcttcttccaatggtggctgatacagtcttttatgcatgatagatgttgttgaattgattttctggtcattattatgaagttattattgcaaacaatctacagtaaacatttcaactctatggaaacttaattgtatcaaccttatatttctttgtgtagtcataaaaactttttttagttttaatttaatatacactttttcactatgtacactcttctcatttaccatttaacgggcttcaaaaattatagctgaccactaaacaatgtgagggtcaagagaacaaaccctcccatacagtcaaaaatccatataatattttactcccccagaactactaatagcatattgttgaccagaagccttactgataatataaagagtcaacccatattttatatatgtatcttattctgtattttataataaagtaagctagaaaaatgaaaatattattaagaaaatcataaggaaaagaaaatatatttattattcattaagcgaaatggataatcctaaaggtcttcattcttggcatcttcatgttgagtaggctgaggaggagatagagaagcgatcggtcttgctgtctcagggtggcagagtcggaagataatccacgtgtgagtagactcatgcagctcaaacccatattgtccaaaggttaatcgtattcttaggaaaatacagttttaaaggatcatgttctgatttaaattgcttgtgtgttgtgaataatctaccaatcattttttcctgtgatagttaccaaagctatgaacatttggagggatatgttaaagggaataagagctacaaaaaattgagacaaagaaataatatttaagtctagctgcgaatacaccttcatttttgtagaggctaggtagtcaacgtttgtttaaaagccatacatttgtgatctctccccgtccacatcctcctgagaaaggtcctttgctctttagcttggatgtctccttatctcagccccagttctgcaaggattcagctttagatgcattctgaggcctctcctctcttacccacaccaagggaacaccctacgctatgacagaaactaggtcttggcctctgattttacgcgtttccaaagtaactactctactggaggcctccaacactcagaagctgacaagtagtaatgctcatcttttttacctcctaaaagctgatcatgcagaaggcatgttagatcatacagaactgaagcatcttcccttttctgagtctctcctttcctcccttctgttcattcctttattcctttgcactacatttctttttctctttctcatctccacttaaaatttctttcaatttttctttctatccaacttttaagtcaatccatacaacttggatatatgccttcaaactgagttaaaaggaaaatactaatagttttatctctcatgaaagcaataattaaaatgacaccatctaataatttaatgtaaaaggagggaaaaattctatttgtattcaactcttttgtttgggcctataaatgaagaactataattttgtaaattatagtttaattttagaaataaaaatgacctcttccctaatatattttaagttgcattttaattacaatttgtaaggtagggcagacttacagaccatccatatcccttttcatgtgaagtatctgtcagcctctggaccacagtaaactttgtcattcacagagtggattcttttttggaacatacgtgataaacaaattgaaataaaacttcactttagttataaaaacttgtagttataaggacttttgagaaccttgcagtccattttttttaccttctatttgaaattccaaactaatttcattgtacttgtaacaatcttccaagaactgcaatcctcaagttctctctttgttatccacttcatggtttcactgtggtcactgcatcattttttacccctatacgcatcttgcttaagataaacccagtggttacttaattttttttttaattcttctttgttttcattctttttaaagaggaacagtaaaataagtagttaggttttgtgtttgtttttgctttcagtactggaatctgcttggtccaacttaggtagagaatcttgggctccagagcgcatagtttgaaaagatggaaaacgttgttctgaaatttgcattaatctactttagattcaaaaattccacataggctgggtgtggtaggtggctcatgcctataggcccagcactttgggaggccgaggcaaggaggatcacttgagctctcaagaccagtctggaaacatagcaaggcctcatctctacaaaaaatgaaaaaaaattacctgggtgtgatggcacatgcttggaagctgaagtgggaggactgcttaagcccagggaggatacagtgagcaacgattgcaccactgcactccagcctgagcaacagagcaagatcatgtctcttaaaaaatatatgtatattttgcatagagtgtctcatgatgactgaataaaagaagtccagtggttaactaatctataattaatcatagaagcaagaggtttctgacaaaatgtattcagcagctttaaatatgaaacccacaaattatatttccagaggtcaaatttgcatataactccttgaactatgactatctcctcacattcaactcagttttaagatccagcagtgtgttgtacaaagtaatcaatggctaaattattcccattttgttagctcagttcacagtagcccactgactggtttaaacaaaaaaaaaaacttatctgatcttcagtttgtatttcaactgtacccaagtgcagatgccatctctggtaatatgacaaaacagatttaggtttctaaatgtttctgtatgctccaataacagtatgcagcctgcagtaactatatcgtagctcaaagtgttgtaaaaaaatgcaactgagtttgctgaagaatcattttagagttaattaaaccttctccacctgtaatttaataaaaaaaagaaagcccaacatactcttaaagacgatgggggaaaggcagtttaagaaataaaagtcctctgtttatccagggaggtactttacaaggcagacagctacaccacagtagagagacaatatttcctcagctgagtcggttaattaaaatgcacagttacaacagactttcttagagcctgcagctgaatgactgaagtctccattttactccagtgtcacacagaacatgaagaggcaaacatactgcctgaacacaatttgactcactaaaatccagcactataaacacaaaatacatttctcgagtgcattttaaaagacttattatcaagatttatgacataaggatagaaataatttgcaactaggcactgccaggagaatatcttaggttcctctcaaggtaattttaagtaaaatttacaaataaatcttaaggttagagtccactttgaacgcaggaatcttcacctctttcctttcaactgtatggaatttgaatctgacaaacaacctgtctgttgctagaatttataagtgatctgaaaaaaaatcaaaggccataaaagctatttgtcaaataaactgcagaacacgatatcagtctgcagggctcatttgcagaactcatgatgagcatgggaggaggggatgctaacagctgcagccttgaccgcactgcccgtgccagccagaattcaagccgcgtgagctgagtgtggctgaaagagggagcacacaaatgacatcttagaagacaaaagcaaaaaatgacaaaagaggttcttatatccaagtttttattatatcagtacatcagcatatacagaggatgacctaaaaaaaccactttaagatagatgggccggcagagttttaaaggttttcaaattaagtctgttcgtggaagacttactttgatttcatggtgtaggagggagatcgtagacttcgaatccactagacctgaagttaaataaacctggggtgcagttttggttagcctggtagcacggcatggtatcagtttcctcatctgtaaaatgggaacaatacttcatgtcccagcacaattttgaggataaattgagataacatatgtttgcaggcacagcaggtgtcagtaaaagttagttttctcctgtcgtttgctagatattttcacaatgcagcaagttgattcaagtggtgaagtggaaattctcacattaaacacataaattgccaagtctgcaatatataaaaaatgattaaatgtccttgacgcttaccaatcattattaaatcaaacctgaaaaggatctaccagcaatttgcaagcccgttattaatatcctttaatggacttgctctattaagtattcttctgtaacaatgttgttcagcaacacaacagaaaaattctgttgttagtattgtgtttcttctagtaattcaacatcatttccatttcataaacattacttgaggaattagttccattatcctacaaatctctctttaaaacattgccataatgtctctctctctctctctctctctctctctgtgtgtgtgtatgtgtgtgtgtgtgtctgcgtgtgtgtgcatgtgtctctctctttcccttttttctccttcctcactttctcactctctctttcctttctctaccccaaacatggacatatcacaccttcccatactcagcactcaagagaacatgctattgttattacagtaaaccaaaatggtctgagaacttagtaactattacatttctagtgtgaaataatttaggcatttaaaggaagaaaacacaatatcaatatttatgtttttaaaaattccagtagagtctgtgaaatgatggctaaattaagcaaaagcaaattaatcaaagagttacaaaggaagaattccaatgggcacttaatgagcacctataatgtgcaggcacataggttgacttttctttcttcccagggcaaacaaaatagcttctcagggcaagggatatcagaaatttggagtcacattaataggaaaagcactgagttaattgactggctttggaaatttacttcacaaagcattggattttctcaagagacaaatttgatacatgtccttcactggagacatgaaaataattcgttctttttaaagactttgaaaagagcagagacgagaaaagctagaagagtttctaaatgacacaagatctgtgaaatgatagatatttagcataaacctcatagagctgttgtgtggattcattagttaattagttagttaatgactttgaagtgttaaatcttattagatttttttttacactttaacacatctgagagagaaattactcttaaattagaaactgactataccactcaaaaagaccatctttttatggtatatcttcaagatgctctttcctgttctgaatttttttcctgaaatcctgggaagcctatctacatcctgatcccaaatccaattcccccaccctttttttttttttcagtattagcattggcttccagttaacactaagcacagccttaagaaactctcacggcgaggtgttttgtataaaaatataaagatgttatgtggtaataatggcatcaagaattaaacatgctacttaaacatagttttgtacttttgtacagcaggggaaaacaaatacaggcatacctcagagatatttcaggtttggttccagaaccccaccataaagtgcatatcgcaataaaatgagtcacacaaattttttggtttcctagtgaatataaaagctatgtttatgctgtactgtagtctattaagtgtgcagtagcactatgtcaaagaaacaatgtgcttataatttaaaaatactttattgctaaaaagtgctcatgatcatctgatcctttagagaatcacaatctttttgctggtgtagggtctttccttgatgttgatggctgcagacagatcagggtggtggttgctaaaagttgaggtgactgtggcaatttctgaaaataagataacaaggatgtctgctgcattggttgactctttcatgaaagatttctctatagcatatggtgttgattgatagcattttattcacagtagaacttctttcaaaattgaagtcaatcctctcaaactctgccactgcttcatcaaataagtttataagtttatgaaatattctaaatcatttgttattatttcaacaatattcacaacatcttcaccaggagaagattttatctcaagagacaactttctctgttcatccataagcagcaactcctcatccattcaagtttgatcatgaggttgcagcaattccattccatcttcacactccatctctaattctagttccccgctatttccaccacatcttcagttacttcctccactgaagtcttgaacctctcaaagtcatccatgagggttggaatcaacttcttcctaactcctattaatgttgatgttttgacttcctctcatgaatcacgaatgttcttagcaacatttagaatggtgactcttaccttaaaggttttcaatttactttgcccagatccatcaaaggaattattatccaaggcagcatgagacttataaaaggtttccaatttactttgcccagatccatcaaaggaattatcatccaagacagcaagagacttataaaaggtatttcttaaataatactctttgaaagtcaaaattattccctgattcataggctgcagaatggatgctttgttagcaggcatgaaaacaacattaatctccatgtatatgtccatcagagctcttgggtgaccagatgcattatcagtgagcagtaatactttgaaaggaatctttttttagcactaggactcaacaggaggcttaaaatgtccagtaaaccatgctataaacacatgtgctatcatacaggctttgctgttccacttacacagcacaggcagagttgatttagcatcattcttaagggccccaggattttcagaatggtaaatgagcactggcttcaacttaaagtcagcagctgcactagcctctaacaagagactcagcttgtcctttggagctttgaggccaggcattgacttctcctctctagctatgggggtcctagatggcatctttttccactagaagattatttagtgtaagttaaagttctgttgtatagtgtaaccaccttcatcaattatcttagctagatcttctgaataacttgttgcagcttttacatcatcacttccacttcaagcgttgtgctgttttactttgcacttttatgttatgaagatggcttctttctgtaaacctcatgaaccaacctcttctaccttcaacctttccttctgcagcttcctcccttctttcagcctttgtagaattgaaaggatctagggctttactctggattaggctttgacttaaagggaatgttgtggatggtttgatcttctctccagaccactaaaatgttctccatatcagcaataagtctgttttggtttcttatcattcatgtgttcactggagtagcacttttcattttcttcaagaacttttcctttgcactaacaacttggctagctatttggcaaaagaggcctagctttcaacctatttcagctttcaacatgccttcctcattaagctttatcatttttatcttttgatttcaagtgagataaatgtgactctcttttacttgaacacttagagaccactgtagggttattaatgggtgaaatttcaactttgatgtgtctcagggaatagggaggcccacagtaagggagggaaatagagaatggctggtcagtgaagcggtcaggacatatttattgattaagtttgtcagattctatggttgtagtttgaaggaccccaaaacaattacagtagtaacatcaaagatcatggatcacagatcaccataatagatataataatcatgaaaatgtttaaagatgtggcaataattaacaaaatgtaacacagagacatgaaatgagcacatgctgttgaaaaacagagctcatagacttgcttgaaacagggttgccacaaaacttcagtttgtaaaaatcataatatctgcaaagtgcaataaaatgcagtacaataaaatgaggtgtgcctgcactctgttggataattaattctgtgagaaaatagagagggagagaattggaatccaatgataattatcttattctttggaaatagtgatcacattttgacctgcatgctggaaagttgagaaaggatagcagcagcataattaagttagcaatattttaatatgtgagagacatttgtatagtttaaacaaaaactttttttgttggcatataatatacatagagaaaagtgcacatatggtcaatgtacagcttgatgaataactgagcacacacaagttctctgcacacagatcaagaaacagaacacatcagcagtgtttcaaagccccctctagttcttccaatcactattcccatacccaaggtaaccactactgttacctgtaacagcatagggtagctttatctgttttggtactttacataaacgcaatcataaagcatgtacttttgagtctcacttatttctcatttgacatcatgttttacaagattcatctatattcttgagtgtagttgtagaactacatatttctcatctctgtccctccccattttctctccccaccacacccaggcacacacatagaattaatccccctcttattcaaatgatggatctacgtatgtacttggaagttcttgataaacttcttttttcatgtattccacagcatgaatgactcaggaattgctaatgaaaattttcctacagtctcttttcttggcgctggtaaatcttaatcttagaatattttgcatttttaaaatctattcatgtacacaaccagctccaagaaggacactgaggtaatcatctttttaagttgcccttgttttcagccccaaatccctgacttttacttaatctctccagggcagccttctttctgtctctggccttcaacttagaaagccagccctactctaatgattgtattagaaaaaacttgcataaactactttacaccaaggtgttcatgcctaaatctttatctttccaaggtatggccccaggacagtgttgtaacttagaggaccaattactctctgattactctctaatggggtatcttgtacagatgcatttcttgagttgttctgaggtcccactatattaaaggacactaagaaacagagctatcacactcaatgctggttttactattagaacattattgaaattaccatttcactatatcacaaggtattttctttatgagggtccatggggaaaggggaatggttctgcttcttctacataactttattttaaaatgtgttgttatttaagcaactgagcctgccctctttgtttcccccaccctctctcactctgtctccctctcccctgctgaaaatataaaaaagcatcagagacaaacactaataaatttccagagactaataagtttctaggacttcataatttgtattttttccctacctttctcacccttggtttcacatactttttctttcattctgttttcaaatatttttttctttttttaatcttgataaatttagggaaaatacagattaactcaataaaatatactatttcttaaagaaaaaattttaatcactgacactaagttaggctggccaagagaggaaaatgcagtcatgtggcgcttagcgacaggaataggttctgagaaatgcatcattaggcaattttgtcattgtgcgaacatcacagagtgtacttacataaacctagatgacagtctactacacacctaggctatatggtataggctattgctgttaggctaggaacttacttgtatagcaagttactgtatagaatgctgtaggcatttgtaacacaatggtatttgtgtagctacgcatatctaaacatagaaaaggtaggataaaaacacaatatcataacttgtgggatcaccatcatatatgtagtccctcattggccacaacattgttattgtagtgcatcactgtatattttagggagagggctcttctcgaaattctcaaattatgcccacttggtgaactgtgatcagacagactgaaaaacctggtagttgaggcatcgtataacatagtaccatgtacaaagaaagttttaataaagcttttctgaatgcattgaccaaagatattttccaacaagcaaaatggacagaatggggagaatgtctaggaaatatctagatcaaggataggataaaagacaaatgcacttgcgtaacaacatggagatgcgtttttaagagagcagacctgttactacatgtgttatgtgacactttgtgacaactgaccgattcttattttcaatgctctcaattaaagatctacttgggaagattttattaatgtgttatttatctaagagtcattgatttatggagcttaaccataagatatagcatggctcattttcattataaaatttatatctacaggaagaataccacaaggacatggggtgttctatcctggactggtaaaccacatatgcaatcacaccaactgatgaaattgaacatattaaatgataacaatctgttatttgctcccttcattcctatgatcctattaaaatgaagtaaaaaaaatcccagaaactcaatgtgaatccataaatcataacataaagcagtccaatataatacttcagtgaaatgttcttttcagtaaaagagagggaggagaaggtgtcaagtgtgggtctcttaattaggctttgtattaattttgagaacaaagacataattccagatcagataaattataattgtgttatttttttctttgctgttaaagctatttgattaggagactctggaaaaagcatgtaatcttgcaaacaaatataacaaatttattgtcaaacattagcaaaaatttataatctgcattgataacattcctaaagtattcaatggagccattcagcaatatgaaagaatgcaggcaaatttctatgattagtatttattcaaatatatattttgccaaatcaataataaatttactgagaaactatcagttgtggaaatattatgataaacatcccctttaaaaatcactatggccagaccaggtgctgtgggctcatgcctgtaatcccagcactttgggaggccgaggcaggtggatcacctgaggtcgggagttggagaccagcctgaccaacatggagaaaccccgtctctactaaaaaaatacaaaattagcctggcgtgttggcatatgcctgtaatcccagctacttgggaggctgaggcaggagaattgcttgaacccaggaggcggaggttgcagtgagccaagatcgcgccattggactccatcctgggcaacaagagcaaaactccatctcaaaataaaaaaaaaaaaaagtcactatggccaatatgaaaattaggacctgttaggttgaaaacatccagtctgcagtgagtataggattaaacatgattggagtaccactacgtatgtttcaaatgcttatagtatgtgaaaattaaagtccattttcttatgcttggcaaataccagcagacttgctagacacaggcagcagcctccaatttcacagggcttgtgttcccaatgcacacctaaaaggatagctttctcacatgttttgtgattctaacaatgtgtgcagagaggaatggatactgtaactatgaaatggaaaagctctagatttctgagtggttcagaatcacgggcctaaagccagacattaaatagaaaacttgtcacttcacagctcagaaagttctaacatctccccatgacttaacacaatctgggctcaacctagtctttctgtttctctatgcaattactcttaataccaatatgctccaacaaaaccatgatttaccactctttgaacgtctccttcagggtctatctctaatttgctcaaattatttcttctgcctggaacattgctttttgacaaattatattttataaccaaatttaactcttacataaactattttctgatacaaccaaaagcatttttcttccccattcaactctaattgtatattattattattttacttctatagccattaaaattttctaacttgaagtatatttacttatatctataattatcttcctttcagggaaattttacagggaggaaaaaatcttacattttttttgtatcctaaacatgcttaaggcaggttttgagatatactatatgtttaataaatgtctgtttaaagaatcatatgtgaatacatgaatgtcacacttgtgagagtctcactgagactctagtatattaaacaaaagatccttatttccctatctttgtcaaaatatgtatgatatttgagatttagttcatatcataaaacattgcatttaatatattttatatatttttaataaatgtttaccattttcagttatgtgaatggctccatacagcaaaagaaccattagaaatataaaagcatcatcctatgaagtataaaattactcctgaattataagcaacctttgtagctacatgcaaaacatttattcagctgcaactatttaatccttacaaaaacaaaaaagcatgagttcatataagggccacactgtgtgaggggcatagagagagattttagaggcttcgcacagtgcagggagtttggtcttaacccattttataggtaaagaaattgaggtgtaatcacatgagacagaatttgaattctgatctgtcggattcagcacctctcttgtcactgtgcagaaactccctttgaatgctagatttcctctgaatagatggtatgcttatttaaatacaagacaagtcattttgccttgctgcactgtatttatcacaaggctattgccagctttttctttaacattaaatacacacacacacacacacacacacacacactgtctttttttttttttaagacagagtcttgctctgtcacctggagtgctggagtggcgtgatcttggttcactgcaacctctgcctcctgggttcaagcgattctcctgcctcagcctcctgagtagctgggattataggcatgcaccaccacccctggccaatttttgtatttttagtagagatggggtttcaccatgttggccaggctggtctcaaactcctgacctcagatgatccatccgcctctgcctcccagagtgctgggattacaggcataagccaccatgcccagcccaacaccatatcttttaaatggcttactatgtttgaggcattgcaataatgtgtcccctaacgtatttaattcttacgacaaatctatgagataggtactgtttactcatattccggatagggaaactgggcatagaaattttaagtaatatattgaagatcacagagatagggcatgaaatggaatttgaacccaagtctttcttgctcctgaatccaaattcttaaccacactattggcttttgttcctctccattaatcctgaatgtgatttatttttttcccaaaaaggaaactggattacttgacctgctgtttgttcagaatatttattttagcatgtgaaacatttaatactacactgggaagggatctagaggacagaaagtggaggtaggggatgcatacagagataggctcatctcacctggcctgattaagttgtttacatttttcagaaagcccatctccaagtccagccctaaaataacagtgaaccttcatctttaatggacataagaccctgtctcagaactctttagataaacagagcacttttcagagagggagctagtgaccttgacaaattggctggctttcctctcattccagatccgtgacattcagcagctaagcctaatatgggaaacaagtcaatattttccagcatgctgggtccattttctccccccaatatttttaagcataagacaggtgcagaaatcacgtcaaccaccactggaggggtgtacagcagctgtcacacagccacacagtggcaaaagtctttgctaagatccaaaatgaaaagaatactcattgtaattgaaactatgcaggggacagagcttcccagatgcatacaaaagttctgaggctttgaaaagagacagatgtcacttttatactcaatctaagagctactacctttcaacagctcatcaggaggtaaaatcaaatcttcagagacaaaagacataagcaacgcatctgtagcagccagaaagtaaattttttaagctacgaagggccttggagacgattcagggtatgccgtcttgtttttcatttgatgacattaggatatcatacctaatggaaaaattaattgtgtgtgtatttatgtgtgtgtgtgtggaggcacgcacacatgcatgtgcatcatgatgatgtactacttaagcaataatgggccattatagaaggtaaatcaattaattctaagttgacattgtcatagtcaggtaaattgaggatctctctgaaaatccattttcctttataatctgacttgcaattattatcaatgtacccattatttacagccagggactcttctgcttggttagtgcttatgtcctactagttgttaaatattttgaaaattagccctgcttgtaatttattatataatttcaacaattttaagataagcctgatacaaaaacaggttcttccctggttagctaacctaagagtcaaaagccagcacagtagtgttacagccgttcagaatgcaaggtatcctttgaaatacttccacagaagacctccaagtagttttcaaaaacctggagctattaatatgattcccactatgttctttaccttccactgaagaaaacagagcctactgagaaacaactctagtgtacagagaaaccaaccagcaaaaccaagtggaagtttctattcaggtctgacctcggttatcttaatcataaacctgacccagttgagcctcgctgatgggctcataacttagttccctcaagatctttctgacttttgtgtaagcaacacacaaatcaatccagcatatcacttctgatatcacagaaaagtaattcttatgaagaaggaaatcattaattgtctttgaatgtgcacccaccaataattcaagttattaaagacaaaaatcttccctagtaaatgctcactgccggttgtctgaaatgagagagttgaaaatgaatacatgaatcaaggaggtttattttaagattttccatattttgatcaaatggtgatgattacattacattttttttctgtactttcccaacaaagaataagtcataccatcatgttcttccagaaagactctttgcttgaaacagtcttactggcacaccatagttagttatgactcatgggttttgtttttttctaagatagctataaacttcaaagatacattaccttataaaaataataaatattgcttagagaatttcatctattttctacataataattttatctttgaaacttaaaatagatatcatccagattgtgcttctgatatgttttatgacatgctgacactgtcctcctaagataatattagatgatataagttttatttttttaaaaattagcccaaggctttgtaggccaggttctagagacactggtcagttcaaatctcaaccagaagagctatgtgaccttggaaaaataacccacccattctgaaccttcatttcctctgctataaaatcaggataataataaaatctatctcaaaaggttgttaagactatcacagaagttttgaaatacaaaataattagaacaaagctggtgcatagtaagtgctcgcaaatactagctgttacttccattctggatatgtacatcataattcctaacttaaaatgctggtcaaaaataaaatttatgcctctactagtcagtaaatccagcctcttctaaacataaaatatttatttaaaataaagtttctagtatgaaatttgaaatatatagatttttcttaatacatttcagtatctgcttttataaattgaatgtaaccatatagtatttgacagacaaatgtgaatcatgttgtaaaccatatatttgaaacttatcttaaatttgttctgtgtctagttaaactaatttaaaaatcaaggttgctgcttcttgagctccttttgcagggctcctcagtgactgcagaggagaaataaaaacgcttaaaatagcgaaaataatgtgacaacattcaggcaaaggcaaggctactatgtacaggagagcatgttgtgcactacacggtcccgcaatggattacaatattaatgctgacctcttagggcaaactgtaggcactggtcatgccccatggatgaatatgaatacataaacttagcttcagttaaaattatgtcaaattgttaacagaaggaaaatgaggtttaaagtccattgaaaattatttttagataaatttggattaaaatccaatgtgctagcaggcctcaaaatgttaagtgatttcctgagaaactgtcacagcccaggtatacccttccttggcggaatcgactgctactttttcttttttaattgctgaattgttcaagtctttcccacaaaaggctgattattataggccttgggctacaagtagagaaattactggactagacctggagctgtggattctggcctaaacactgtcattggcttgtaatgtaattttgtgcagttttctcatatataaaacggaagtaataagctcagatctcaattaggaaaagtaccaagatactagacgtaaacatgctttggaaaacattggagcacattaacatatatagcattatcaaagtctttccaaatttcttatcatataatacatggtaaacaacaaaatagaaggaagacttcctctaacctctgaaaagtcagaaacttttcctaggtgcctttggtattttctaatcttactctgagtattgtttccctgaaaagatccattttattctgactcaggtacaatataagacaggaaaatggatgttatatacatagatcatcaatagagaataggaagaaaaagataacgattattttgtggtatcattgtatcatgactctgaataatatctatcaattactgattactcactatgtaccaagcccagtaggcactatagaaatgtataatatcttattctcacaatcaccctatgatgtaggtgataaaatacattccaaatgacaatgccaattcagtaaaattaatcatcttgcatgacagtatgcatctaagaagtcgagggagacagaattcaggcacttatctgtttggctccaaagcctacattaattccagttttcctcattgcctctcataacagctggcacagagtagacactcaataaatgttggatgaatggatatatggatagacacacgactgcatgacttctgggaattagaatttataagagcaagactgaggccacctatctagactgtcacaaactggagatcagcctccattgttcttcctcttctgtaatttgaaaaccctaggttacaagagtttcttcattgatggtataaacattacccattctcctagtatttctgccttcacagatgagggatttcaaattcttggagcccattgtgtctcaccttcatcaccaagatctgactggggggtatctttctctagtgacgctacaacatggcatttggaaatttgcttaggcaaaatttagtcattctggtcatggagtagtgctctgccagaaaggggtgctcaaatctaacttgcagagcctttaagggaattctgcagaagctgacaaaaatattaagaccctagagctatggcatttggttttgttcttgtgcattttgcaaaggtacctgaccacccaaggaagaagaacctttttgcttgttagccttcatatttcctacatgtgggggctgcatctgcccaaagagttcctctttttctaattaacacaaaggtgatggataggccagtggctgtcttgtgcaaatctaggatgcgtttcaataagccagacccagcaaatgattctcaagcttagtaaggtttgaaaaccactggtaagagttttgggagcagaggggattcttcccaagggaagtgggagtaaattgagccttaatgagtaggcattgcttgctatcttgttaatgtattgaccctgtaaaaccaactgatatccagagttaactggcttgcagagcttgggctgagaatctttgcaagttattgtcatccaggcaataaacaataattacattatttctactccttagcaaggaggaggcaagctttgcaggcagctagtaagagttgtcagttccctccagtgaaatgttctctgcaaaaagtcaatagtcaaaaggcataatgctgtcatttcagagtgaaattaattcctcttattatttttacctgttgctctgttttcctgcagagtaaatctcagtattctgactgtgtttaaaagcatctgtatttttccaaagtggttgcttaactgatttcaactgaatttggcaaatcacactctaagaggagccagaaaactgatgcagtgacaggctcaacagtaaccaatattccgtttaatcctaacccttaggagatctggcaagggcctcatcctcctacgggacaaaaagagtttagaagctttttggggaaattatgtagtaagtgcacagcaaaaagaatgcctaatggctttgctttggggaaagaaaactagtggtaataaaaccatggaatgtagaagataattcaaaagggaaaagtggacaaacagccataatgctacctagctctgtctaaattgaattcatgacatgtatctatcacacatttcctgacaaaccatctcctgatgggaaatagagaataaacaggttatgtgaagtctttagtataatgttttctttcttggtcaataggaccaactttatcaaagatatctcccacagtctggcttcaccaagtaaatcaaaagaagtgagatgtaatcttttattatcattttttcctaaatttactatttgctcatttattaaattgaaagaatacatttattccacagtagaaatgagagacaagtaaaaaatactttagaagaaatatatccagaatatgtgtgtgtatatatatacatatatatatatatatatatgcatatatatatatgcatatatatatatgcatatatatatatgcatatatatatatgtttgatcctgaaggaagattacaaagttttcttgtactcttgggcatagtgggaaggacattagaatagggtaaagagtcctgggtcccagtcccagcactggtgcttaccagagctgtgccagtctggattctgtcaggaaacagatgatacactcaaaaggagtgactcaagaaagttaatccagcaaacctttgcaaaaatgtaggccgacttagggggagctggcaaggatggtgaaacatggggacagcatcagcaggatggcatcaccatcctaaggcagaagacaaggggaaaatttgctagaactgctgaaaagtgtgcttacaggagatggtcaccagcattgcagccactactaagctaggcctgaagggagccagagaaattagagttctcctttctctctccttctgccacctggacttacgcatatgaaccctacatatggccaaatgcaaccagaagcagtgagagggccctctgaagcatttcataaaggtgagcctctgtggcctggagcagggtacagaggaagggtacatagaactagaggggccaaaagcagttattgaacacacaaactatgcaattttgatcattcatccttgctggccttcagtaccagcttccagaacattaagaatctgagccagataatctcaggagtttattccatctctagtatcatttgtgaatattgaataaaagagaaaggaagaaaataaatattctaattggcccaactgatttatttgaaacaggaagatttagcaacttagcatttattggttaacaaaccacaggtctttttttcctccacctgctttcttgcaaaaaaaaaaaaaaaaaaaaaaaaaatgcctgtgcctgaaggttatttagaaaaactcttgaaagctattaatagaaagcagatttaaactcagtctctaaaaggcttaactttgtgtactatagttctgcctttgtagaaaaataaaaagcttttttttttaaaaaaaatagcatatagctcagattattagctatctctttgtcacaaatgtgcagctgggttcagaatttgcatgtttcccaggcaaaagaattcaataagtaagtaagcgaatcctgccattttattaaatacttacagaaaacaaaagcaaagcaagctttaactcagccggaaccagaacataatccccagagccaataacacatgttaaaattccagcaccagagccaaatttgacaaaggaacactcactatcctactactcctggggcaaactatcctaattttgattctcacactcttgcattttgagatcctccaaatatgactgctcaaagaagaaggaaaggaattaaaatggggagagctaaggtttgagatttaaaatgcactttcaagatacgtgataaatgggaggttcatgaaagttccctttataggtcagatatcatttaacttgtccaagtagttacgcttctattcagacatagggagagagagtgtaaatgaattatctcctccccacagcctttctacagacccttctctcttaattatacacatccccattgcacaggtcctgccaagcgctggtatccacagggtagatgttgaaaaaagttataattactatcttcagtctgctgctattttacaccctcagactcacggcaaaagcttacagcagaagttggcttagtgtcctaatgcagcagattcaactttttgacaatcttttattctcttcaaaacctcttcctctctatagaatttcatgttcccaaatcttcagtgataatggtagcattctcagggaatgcctggattgatgatcagggaactctttgagctagaaaccaagacaggatttctatttttattcctgtttcaatcctcatgcccagtaaaaataatgagatgtttctttaaatcatttattttatgaagaggagtcaggattatcattctttccacttctgcggcaattgggccaagagaacaaaaatatgcaagggttcagaattcagtcccctgagttctaagggctctgcccctggttatttccatgagcttgggaaagagaattaacctctctgggaaatctggaaaatgaactggtgaaagtagatgatttctacaactactttcaggtctaacattccacaaccttatttgtgccaatgcccccattctactctcagtgcaactgaacttacttgtccctcattgcaatctctaatttcttaagctcgtcctaatttcttagcacacctttctttcttttcctagctttaattttctctctatccgaccagaaactcaggagtaagaaactttgctgacacaaactgctatctttcttttctctttcttagccccatcttcttctaccaaagccatttggcaaggtctccaatctcaagactccctccacatctatactcctatgtctaagtttctaagcatgagttggcaacacctcaaacaacagatcctgctacaaggctagtctgtactgagtttataattgtttcctttcagaagtctcttcaagccaggtatgtaagtttcccatgttgaccctcatagctatttgaaatttttttttctttgctagcagactccctaaaaatatttctttctctcctctttcctcaagctctctgccttctctctctgcagataactttatttttcataaagtgattataataaaaccattttcacaatgaaaatgtgtagaatttaaaatacagaagttcatttttagtttaattacattaacataaaaaatgatcacaaatctcctacaaaaatcatggagcatttttgcatttctatatcacttccaactcagcttcattttgatttataagcttgactacacatctagctgtcaaaccagatgttgtatggaaaataccagctaagtctgattgaatttttcaatttgcctcatttgaaaccctacagcaaaacagaagtagttaagaacttcaaaaagttttagagtagagaactaattactaattacaatgatcttttctcagataatatgtagcatgaaaatacaagttaattattcacaaatgactacaagagaaaagagagaaaaacagaagacatttgttaattgaatcaaatattgtgaacatattccatctttgacattctgaaagatattggaaggttcatttaaatttgcaagcatctcttcatagcataatattccaaattaaaattttaagggggaaatacagaacagaacagaatggcataggatctatggtggatagcaactttagttttaattccactttgtgactgcccttagaaaaggggggatggtagggttaggaatagtgacagtgttgataaagcataggagaaggaaaggatctgtagaaatcttgagagtgaccctaaaatgggaatggttcttaagtttttttgctaaggactactagttaatcacaagggatcctttctgagaacaatgtttttaaatgcataaataaaaatataggactataaataacttcaattaacttgacatagttatcacaatattaaaaacacaaattagtgatacagtaatagatatgctaattcataaaatgttcaatagcaaggtcttctagcaagtctagaaactgccatcatttcaaaaaaagttacgaacataaacattatctttaaagctagctataatacctgtagtctattatgacaatattggtgatttctattgttttgtatagtctctgatctccagttcatctcattctctctcttactcactccaaaattttgctccacaattctaccaaaactgctccccttaaggccatcaataaactccacattgctcagtctaaagtcagttctccatcctcctcttacttgaactgtcagcactatttgacacagttgatcacattctccttcttaacctaccatcttcattacattcaagcatgccactcactggtgattttcttccaacctcactgggactctcttgtgaagttctcttttccatttcatcttaccaacctcttaatgttggggtgtcccaggttagcccttggaccttctcttttgtgtgtaaatttactcctttagtgatttcatcaatactactgatatagacaaatcaagatgactccagatttatatccatagccttgatctctcccctgaattctagatttgtatatcctattatctatacaatatttgcatatattaagtttgaaatgtctattactccttgaggacatttcaaaggcttaatagacatttcaaacttaatacatgcaaagtgactatcctgatcttcacctccactccctccccactaaacctattcctcctctaatattctccagtccagttaatggcatatggaggccaaatgtttgaagtcattcttgatgtttttccttctctctcaaagccacttccaactcatcactaaattctatgattagaagactccacgctgtaaatgtaacttaagtctctcattttactaaccatattgccactactctggtttaagccaccgttattcctgtcttggtttattgaagtaaggcttccaccttcacctcatctcaaaatgtgggctagagtgatcatttaaaacataactcatagcagtcactttcctgttcaaaaccctctagtgacatcccccatttcctcatcatgaaaggcaaagtaattacaatgcctcaaggcctaacagaatttcatacaatatacattttctcactgaccttatcacccactagcctctctttggcttattacaggaagagaacttcctcatggtctccgtacttacacctccttctgcctataatactcttgccccaaatgtctgcctcctcaactcctctaagtttttttttgttttgttttttgtttttgtttttgttttttttttgagacagagtctcactctgtcgctaggctggagtgcagtggtgtgatctctgctcactgcaatctccatctcccgggttcaagcgattctcctgcctcagcctactgagtagctgggattacaggcacgtgccaccacacccagataattttttttctatttttagtagagatgggatttcaccatgttggccaggatgttctcgatctcctgatctcgtgatctgcctgccccagcctcccaaagtgctgggattacaggcgtgagccaccgtgcctggcccacctcctctaagtctttattcaaatgtcccttcaataaggccttcatgataccccctacttaaaatggcttttagaattgtttctccttattttactgttctccaaagcaattatcaccatataatatagtacttattttattcatttgtttatctgtcttgcccaacaatgcaccccataaaggctgagatttttgcctggtatgttcacagatctctccccagtgcctggcataaggcaagaattcaataagtagttgttgactgaatgaatgaatgaaggggttctttggaatcttatcttccaggaagtctagcacatttatccattgcagtaagactcacacatacttctacttgccaaaactatatcatactctgtaaattaaccaaaattattttaaatgtgatgcttgaaataaaacaaagctagtacttacagtatttgctatagaaatactgtaaaaactaactagtggctcacaaccacatgggacagtgcatccacaaggagatgcttcattatgccatggaagagcaagcactttgacacaaacagacttttagctttgaactccacctctgcaacttgtgagctgtgtagcactgggaaattatttacctctataagcctcagttatttgcttgtagtatggaaaatgtgattatatgattaatgcatcttaaatgaaattatatgcacaaagttcctgggcacttgaaaaagatgatcctttcatcattcctcttgacaacgattactttccaagtagatgtgagcaaataatagtgtacttaaaaatggtcaaatataagaacaggattggaaagactgtgatcagatgaactgatcacctgcagtggtagtttgggtagagaggtttactgggttcaccctaaccctgacagttcccacaaaaatgatatttagatcccttttcagggtaaggtatagagggcatgtcgaaaacaggttccaaaatagaaggagaccaagactctattcatgagaaagagcagggtgagacattatcatctgaaatggaaggtgacaaagccaagcagaatttgggctagaaagtggtgttgccccattctcaaggatttgttgttttatcagtgcatagacatcaattttttttttttttttaagatggagtcttgctctgttgccaggctggagtgcagtggcgcaatctcggttcactgaaacctccaactccctggttcaagcaagcaattctcctgtctcagcctcccgagtggctgggtttacaggcatgcaccaccatgcccagctaattttcgtatttttttttcagtagtgatgggttttcaccatgttggccaggatggtctcgatcttctgacctcgtgatctgcctgcctcagcctcccaaagtgctgggattacaggtgtgagccaccgcacccagccagacatcaatttctgtccacagtaacatcgtaggaaaaactttgtcacactgctttgggattcagcacaacattcttctctttccttagacatttaaagtatgaggattctacattgaagagcaggtcttttttttttttttccgcatttcaatctagatgtttacattggtgggggagatacacttagaagcagtgtgctttttcataaatcactctaccttgtttctctcatactttaaaattacatacatttttaaactggcacaaaagtactgtcttgggagaaggcaagaaaatagataaaatgttcatcagatgataacaattgtaaatattcataaatcagggaccaggattcctatttcctaaggaatgtgctcagcctgggagaaacctcactttagaccagtggggctcttgggcactttcatcatgacatttaaacaataaatgtatctgtcaggtgatggtggattcacttcggaggaactgacacctttgatgaccatcacaggactgagtcaccaattatacctacagcctgcacttggttttcttctcttacagaatttcatgatccctccctaaaactgataaggcagcatggaagtaggagggaaaagggaggagataaagcagatgagaggcagactgcaaacccatccagctttgcaaggactgagcttcatcgctcacagaaaagtcaagttcaagtcacaactcaaaattaaaccctgactaatgtaaaaaacctgtgtttagaaacattttacacaaaagttacattttggaataatagaaaatttaaagctattaaaaagcaataaaataagatgaattctgcaataagattgccacgttccactcttgaattaaagcaaacaagcaaatatttccttcctaaaacttcctgcctttattctgctggcttccactctgtgagggccaactgtgggtcaagccctgttctttgtcccatgccaaaaagacagctgggagccacggtggaaggcagacaatgccctggatttaggtactagtctcctccaggttgtgtttaaaaagctgggtttttttggggtttttttgtttgtttgttttttggctcggcatggtggctcatgcctgtaatctcaacactttgggaggctaaggcaggtggatcatgaggtcaagagatccagacgatcttggccaacatggtgaaaccctgtctctactaaaaatacaaaaattagccgggtgtggtggcaggtgcctatagtcccagctactcaggaggctgaggcaggggaatcgcttgaactggggaggcagaggttgcagtgagccgagatcgcaccactgcactccagcctggcgacagagcaagactccgtctcaaaaaagaaagaaaagaaaaaaaaaaaagctgttttttttttttttgtaattaaaccaaactaaatatttcccaggagggcaagacagttcccaaaatgtctaacgaacttccacgtagagaaaacggttactgattgtcccaaagcaaaactgtagcaaagcctttccctgaatttttctctcttccttccatcttcttttatttctttgctcagtcaaaggccgcatatgtttcaaaggatacttgatataggagggtagaacagtactttcagcatgcagattttttttctatgttaagtgaaaataatgatttcatgaaatgtgccttcccatcattataaaacaattttgagagaaatccatcctccttggcaattccaaagcctgttgtttgctttgcaagcactatataagtctggagaggggcctgaaattaatatagctcagtaccataaaggcagtgtatagaactgtagtcaggacttaagatttgagtcttttgcttccttcactttgacatattacttgagaggcctgtacctcagtttcctaatttgtaaaattgggataacaatagttattattttatagtgccattttgaaaaatagtgaagcttctgacagaagacctcaataaatgttacatattttaaccatcagcattaataaacgaaaacaattttccctatttttggtcagaatttaggaaaaataagttccttttaaattatgtgtagacaattaaattaatcttttaagtaaaaaagtcttattctcatttttgatgtacagaattttagcatcatctaactaatcctaaaagactttgtataatgaaatgaaaaattaatttatttgatgtcattactttttaaaataaccaaatgtcatatatttatcattttaaagaattaatatgcagctgggttaactcggctatgtaatatattttttttttcaggatatacctttcagattattcaaagaaatagctaaaaatgagctatcagattcaaagaagctttttaacatagccaactgtaggtcagttttagtgttaaaaatttaatagatcatacacctaatttacggcgagggggaagcagtggctacatttaaccaaaataagatgttcttctacaaacattaacataagaataaaaaccacaagttttggggtgatcactgataggcaaaccatatttagaacttagcagggttctaaatctgtaagaagaaaataaatatggaaaaaaacaacatgaatcagtgtgctctcacatctccatatctctgtgttacccaacatagaactatagcttatttaagacatgtttagtagcttttcccatactttcctgaattcattccctgtttcaaattcaactaaatgggagaattagaagagaaattttttgtatttggatatcatggcctatcttacatttgatatatgctattgcaattttcttaaaatataagttcatagcgcaaaaagaaatattaagtataacatagaacctggtaccactataagcaggtgattattaacactccattaggaacgttgatggttctgctaatgaaacaatggttatagcaaaaaatagactatttttctggaaacgtgagatttttcttatgtgtacaagcacatacacgcatacattagccttgacataaaccatgaccttctatttgttaacaattaaaacattgtcttatataagcccaggtcatctgctagtggatagatatagatataggtatagatagatatagatatggatatagacatatatatatatagatagatagatagatatatgtagatatacatatatctacatatgtgtatatacatatatacacacatgcatatatatatacacatagcatgcatatgaattacaattaattaatcaataatggtcccatctggttaactgcattggaaaatgacatctttccctcagcaatacaagatttcaaccactacttgcatctgcaccctctatacctttaagcagtatgcaaatgatacaaccatatgaggcgggactatgtaaaacagtccattaaaataattttcccagatcaaataaaaactgacacattttctaacatttattaagaatttttaaaaatgaacgttctaaaaatgaagtcttaagaaaattctgaggtgtgaaacataaagataagagtgccagtgagaaaaataatctgtttagtagatttaaattatcattatatttcaccaaatcctgttaagaaagaatatatcccctcgaaaggttcaattctacaacaatgagtagttaataggttcttagaagggaggaagtcattgtactactgaatagtaataaaatctatgattcagtgtgtttcaaacatttaggaatgctttttgatgaatgggttttttaacagctactgaattggatttgtcctctttatataaaagtctaagtctatactaaaagaaaagaaatttatactctgagcatgaagttaccacttggaagtagttctttgccccatgactgctgagcctgaaaaacccaatctgtttctagaaaaaacttgccaacaaaatccacagaatttattagatagaattactcaagagcaaaataccatctctaccatcatcaaataagagtatgttgctggctgtggattttggtatagttttaatttttaaaaacagtttccaaaacaataccaagaggcagtttgattctacagtatggcaagtaaggaatatcagacactattttagagtatatatctaaataaatattatatatatatataaaacacatcgaaaaaagatatacatacatattagtttgacattaagggaaagaaattaaaaaaaagagacaagatgaatttaaactagagaaaatacaattttagaaccacatttaggaaagacaaaatgaagaaactggatatgaagaaagttcatatctaaaaaaacgtggttagaagcgattggattcaggagtttctgcaaacaaaaaggttgtctcctcagtgcctaaaacagcacctaacagagaaaagacactcaatacatattcattaaaagaagaataaataagtggctatgaaactgggtatacagcaccatattgagtcttaaagttacatttttaataggttaaatttaaatacatatttttggccgggcatggtggctcacacctgtaatcccagcactttgggaggccaaggtgggcagattacttgaggtcaggagtttaagacgagcctggccaacatggtgaaaccctgtctctaccaaaactacaaaaattagctgggtgtggtggcatgtgcctgtaatcctagctgctgggggcgctgaggcaggagaattgcttgaacccaggaagcggaggttccagtgagctgagaacacaccactgcactccagcctgggcaacagaatgagactccatctcaaaataaataaataaataaacaaatattatatgtaaatatatatatttactttatgagctatttcttttaaaataacatccattgctttattttctgactgcaaaagcaaatatactcattgcagaatatttttaaaaatcaaatattaataagaaaatgtaacataatattaatagacagataaaaccaccagcaaacattcatacatctatgcacaggcatttatatttacaaatgtgaaatgatactgtatatcaattttatgtcttatttttataacttatcattacattgtgaacatttccatgtcattaaaacttcttcaaaatcatgagttttaatggcctcatatcgttccataaaatgaatgtgcaataattgaattattatgctattgatgcacatttgaataatgtataatatcaaaaagttggggagaaaattttaagcagctttatccataaaactttaattgtatcttggattatttcctcgggatacatttttatatgccaaattgctgcatcaaaaggacagatttagcatttttgatccataacaccacactgttttcatgataatttgtattataactgctcccagtagttatgaaaatttttattccatgatacttcaaactagaaattttaagatctcttttacaatttgataggtcaaagctgatatacttcaaacttgattgctggtgagattgaattttttgtttgtttattaactatttgtacttcttttgtgtgagctgcctcacatttgaggagaaaagctgcctctcacaacattcataaggcttcctgaccctagagaccctctatatttccacaacatggagagtatctgtaactcctatcagaaacatcttagtgaaacagcatgaaagtttatgaacctcaggattactacatgaacatgagagtaacagtactgacctacctcagagatttctcccacatcattattacaaagtactataaggctagaattgacttggagtcaaggcgagttccataggtttaatgcgtggcacctatctcaacaactgcaaaatcactgtaacttgtaaaaaatcccagggccactcatggacagccacatctttaaacccacacaaaaatacagacactttgattacatgaaagttagaagctctaaactagagcaaggtcagttgtggtaagaaggtattagattcaagcatccacaaaagtttatagtctgtcagtcataaggatggctattgggatttctttacagttactctgttgtattttcactttggttttacagcactatctcttaggaagtcatccatatattacctgcatacacagtcagcttcttctcgatatacagcagatatgtaacaattattctttccttcccagacagtcatggtaatattacatttgagttcagtgaggtaactggtagccagaaatactccacaaaaggtctatattcttgggtgggggggggatacaattcttctattagggaaatttttatcacctacttatttttacataaattctaataatgccaagaaaatacatttcaaagaggaaggtatagaaatttagagatgactgtgacctcaaatatccatgaaatataaccagaaaatctgcatctacataatgacactattttcacatagccccaaaatgatatcttagaaagccaaaaatctttccttatctccaggcagaactatttcaaaagataacaaatgattgcccaagtgatatttgaattataccaaaaaagagacagtatatacatggtaacaccatcctctgtgtattatttcctcttggtagtccttctgtttttcaagataatacagatctcaagaattctcaatgttcaagcaagaaaattccctcaaccaagtgaaatagaaagaagttatctattaattgtgccaggatttcagttgttttctttcctttcttcttttcatgcaagtttatttgcctttctatgagtatttgcattatttgctctttttcccctttgaatcatcttaaaggaaaaaaaatgaaaatgtatctatttggactttaattacactgggcagcaatgaggcaggatagtgaagttaaaaaaaggctgggtgtggtggctcacgcctgtaatcccagcactttgggagaccgaggcaggcagatcacaaggtcaggagttcaagaccagcctgaccaacatagtgaaaccccgtctctactaaaaatacaaaaattagctgggcatggttgtgtgagcctgtaattccagctactcaggaggctgaggcagaagaatcgcttgaacccgggaggcggaggttgcagtgagccgagatcgtgccactgcactctaagcctgggcaacagagagagactccgtctcaaaaaaaaaaatacatacatacatacataaacagtgttagaataagcataagactgtgcttaaatcccaattgtactctttataatttgtatggctttgtgccagttttcatcttctttaagcctataaaaccaggagtgtaattcactcctttactatgaggattactttatgtaatgcacctagtagagtgcccacttagagtaaacactcaataaatgacaaatgtcatcattataactgtgttggtaagaacaggtaagggtataaaccactcccacctcactgaatttgcaggcaattcctggcaatagtgcccaacaaagagaaaatataccataaacataatttattttaattacaagagaccctgtcatctctactattattataaattaacaataggttcttctctttaatatttctcatttctgagccaaaatcattttttttcaacaaggtcagagcatattcttttttttttaaacatgctaatgtacttcagtatattccattctgtaatatttgtttcaggaaatgaaaattaaattttctttaattaacccccatgactcttgaaaattttcctcattgtccttgaatctatggtctttaacagtctttataatatcttgaactctacactccactgagcttttaagctttgtttagtgttgccatagcacacctactccttatgatagaatatcgccttctcaaattaacaacatatagtcaatttattgtggttttccagtttcactggaatgaacaaagatttctttctctcacaggctaaagttttctccctccttcattattcggcttcagagttcaactcctttacccacatgacataatcagctcaaaatttattatactatatatagcatcaaagaatacatttttttagagatgaaatgaggtctatgttgcccaggcttgcctcaaactactgggctcaagcagtcctcctgcctcagcctcctgagtagctggacctaaggcacgcaccactgtgccttgcagaatacattttattaacgtaaaaatcattattttcctcttacttctgcataaatggtatttttggtccatttgctctcggagaatagttaactttgtcattaacaggcccatccagattgttttattacttcagttgataaaaatttatttcataaagtgctttttctaagtaagacatgaacataagcaaacccataatattaaaagctttatatagatacaatttaaaggttctgtcaaatagattttttttttttttttttttttttttatgaaatggagtctggctctgtcacccaggctggagtgcaatggtgcaatctcggctcactgcaacctccacctcctgggttcaagtgattcttgtgcctcagccttctgagtagctggaattacaggcgcctgccaccacgcctggctaattgtctgtatttttagtagagatggggtttcaccatgttgacaagtttcatagattaaaaagtaggataaataaatacagtagagagaaataacatttcagaaatgtcagtattaaaaactaagtcaaccacaagcagttttacatcatgtttacaaaatatgctataatagtaatacacttgaggagggttaaaaatggttctttttttattgcttctcagccttttggctaagatcaaatgaacagttctttttctaattgttcaaattgatttcatagtcttgtaatctacatatttatgaaaaataattttaaatctcttataaatatcaaaaatgtcagtttccaattgaaataaaacagtattgagtaaagactataatgtatgagttttgaaaaagaaaattgacaattagaagaaaatttcataatattcattgtactaggactttccacatttttgatatgacgctaacatcaatattacaatgaattctcaataatttgtattaacaaatgacaagaacaatctgaactaaattgaacaataaagtatctgtaagcttagaagcattaatttcatagtaactaaacttttggtaaccaagcaattctatatagaagacttttaagtatgcccttctaagtttgttttagtaacattctcatttataattagcaatatataatttattttttaaagtgctaaattaaatacactctcaaataattttgttagactattaaattacttattttgtttcaagacggagtctcactgtcaccccagctggagtacagtggtgcgatctcggctcactgcaacctccatctcccaggttcaagtgattctcctgcttcagccttcccagtagctgggattacaggcacccaccaccatgcccagctaattttttgtatttttactgagatggggtttcaccatgttggccaggctggtcttgaactcctgacctcaagatttatccccctcggcctcccaaagtgctgggattacaggcgtgaaccaccgcgtccagccttatttatttttaatcaactttattgaaatataattttcataaaacaaaatgcataaagtatacggtttaataggttttaccaactgtatacaccagtgtaaccaccacacaaatcaagatataagaaaatttctatcaccaaaaaagttgccctgagtctctctgtagtcagtcttcttatgccctaccagatagccactgatctgtctctatcaccacagattaattttgcctaatttcgagcttgatacgaatgaaatcattcaatgtaggtttttgtttcttgctttcttttgctcattacaagtttaggcctacttctgattcacagcttctggtgacataggctggagaataagttattccttaagaagaaaggagtaatctaaaaaagtgcttcttagcagttcattcattttaattgctgagtaatactcccctgtgtattcctatacagcacactttacgcattcacctgttggtgttgatggacatttaggttgcctccagtttttgactattgtgaattaagctgctgtaaacatttatatacaagtcattcgccagcatatgtttttatttctcctgggtaaatatttagaattgtaattactggttcgtagtgtaagtgaatgcttacctttttaaagaatcttctaaactgttcttcaaagtggttattccatttcacattcccatcagtaatgtataagagtttcattggttcatatcatctactaatacaacacttaatatgtgactttttgtttttgttttgtcattttaatgagcaggaagttatattctcattgtggttttatttttaatttccctaatgactaatgacattgcacatcttttcatgtgcttaccaaccatttgtttttttttttctgaagtgtctgttgaagactttcatctatatttagttgagttgttttttcttcatattgaattctaagcattcttaataatacattttttttaaggagaaaaaagtattccagtccaggtcagcacaagctctgagtcaagaataggtctaaaatccacagatgcaattctgaaacaataggcctggaatcaaaggtagctcttgatgaagaggagatgagtaatctggtattttagactccattaagactcgccattttgtagctgaccaaaagggtcattctttagtcccatttaaaatcggcatttcatcatttcaaaaatcctgcttcaatctaagcaaattatcatgtgattctgcaattgatagctagctcaataactgatttatttgataagagggaacacttagaaaatatacagctctcatattttctaataaaggtattcacatataattaatagtaataagtactatctgtgagtagtatgcacaacatgcatgctgctgtcttttgcaaagtattaaagcagatgcctaagcattgtaggtaaggatgtacttgacttagttatgatttgattaaatgttccctgttcagattggcttctgaatcatcagctactggtgtaagtaaaaataagttggaaaggtttccctttcctgaggatttcaggaaaagcttcgcaactatttggctggatattgcaaatcagatcaagaattgggaagcggtctgtctttgacttatcttgcactatccaattctatgagtctatgattgtcatgtacagagcacttggcttagtggtttgtgtataacttttcaggattagtggtggcattgagctggttcatccacaagtttatctggttctccatcaagctaagttcgtcctatctgcagagcagacacagtatttctgctctttattcttggctgtttcctctatttagcactcctttctgtctgtttttctaagttaacacatgatattttggtattttaaactccattaagacttgtcattttctatctgaccaaaaatcttggtcttcttcaatcagtatatcaatacctccttataggaaaatatataaaagtcatttattctaaagcataaattatagaccaataactgcttaacatgctactgcagttaaaaaccagagttgattcttttctaccaactgccctctttaatttccctgtataaaaggcccaataataggtcagttagtccacaaaattttgttgaatacttactgttaggtgctagtagctttgtattaatgaaacaaacattgttcctgcctttgtaaaacatatgttcttgtgagaaggactttaaaaataatttaaagtaactcatgaaataattataagtatttctaatagtgcaggtgagaaacagtgttggagaacatagaaatggaatggcggcactaatatagggaatcagggacgatacccctgtaaaagggatatttcagctgagacctgaaattaaggaactggtaaggcagaaaaagtagagaagaacatttcagacaaagaaaaacatgtcaaacatcctctcgactctggaacccacatgacctttccatttttctcaccaccacttctattcttgccttcatctctttttctatagattactccaatagcctcattactagcctaccctacaaagtgttgaaagatgtcttcatataatataactgtaatgacatcatctcttcctaaaaatctacagtgacttccctaaagaaaaatggtcatattcccaagtttggcatttttggcccttttcaatactaatcaaacttacttttccaatcttattttcatgacttttctgccacactgatctatttactttcttcgtcaatacaattttattctctgaacttagtgctgttttctcattattcatttcatctagagtaagtctttaaatttcatgtaaatgattattttattggtaaaatgtataacaagtcacaggcctcttaggagatacccacgtttttgtttttgctcttgtttttgtctaaagacagtgattgctttccaaataactactttgatgtgcttatcatttggttactgaaatgaaccaaaatttaaatttctagtatgggcgagtttattgggcctttcaggtgaaaatcaatgtaattttatatctacaaatgcttccaggagaattagccaatggttgatagttccattgtctaaaataatgacctaatataaatcaatgggaaaatagattaaggcttgaaatggcaagatttgtttaaaggacctataatgggtagaatatataaaggttggccgggcacggtggcttacacctgtaatcctagcactttgggaggccgaggcaggtggatcacgaagtcaagagattgagaccatactggccaacatggtgaaaccccgtctctactaaaaacaaaaaattagctgggtgtggtggctggtacctgtagtcccagctactcaggaggctgaggcaggaggattgcttgaacctgggaagcagaggttgcagtgagccaagatcacgccactgcactccagcctggcgatagagtgaaactctgtctcaaaaaaaaaaaaaatgtataaagatcatatgatatgaccctcagcctaagcttagcaataaaactttagaaactacaagagtggcctctgttaagagctcacagaaggaacaattttctatgcttcactgtcacgtgtaaaatagaaagccagaggtacttcagcattcctatctaaagagcttccaaatgtgctctaaatttgtagatgtaagctgggccttgtatgttttaaaggttaaataaatcttcagatagctatctactattgttagataaaggagtcaactttttgccatagcaaagtaaaggaaacaggattctcttttctgagttgggtggatagtttttgtccataattctgtacttccaattgtcactaaagatatgtcatgctttatagcctcctatatgtctggatcacttgtgctttcatttggaaacaatacaaaatagtttataaatgtaagtatccttgtttaatacttatggaaccaaaacatattttaggaaaaatgacacttagtcaaacttttattcctaagtgtggaataatcaaggttgtatatagaaatccatactttagtataacatcatgagtgaaataaatttgcacacacatatatatatatatacacacacacacacacacacacacatgcgatgacgttcctgaaaatatgatcctagataattaagagaatggggagttgctattcaataggtataaaatttcagttatgcaagatgaataagttctagagatctgctgcacaacatagtgcctagagttaacaatattgtattgtgggccaagtgcactggctcacacctgtaatcccagcattttgggaggccaaggcaggtggattacttgaggtcaggagttcgagaccagcctggccaacatggcaaaaccctgtctctactaaaaatacaaaaaactagctgggcgtggtggtgggcgcctgtaatcccagctattcaggaggctgaggcaggagaatcactttaacctgggaggcggaggttgcagtgagtctagatcacaccactgcactccagcctggatgatagagtgagactccatctcaaaaaaaaaaaaaaaaaaaaaaaaaaatatatatatatatatatagtatggtgtacttaatatttttaagggagtagatcttatgttaagtgttcttaccacagtttttaaaaagagagaaaaaaacagagctgaaagaaactataaatagcaaataaaaattagcaattcataaagttccagtgaataaatacatttactaaacctgtcacattattttataaaggatttttatttaattaaataaaaagtagcatgaaagcaaggcctgacatatgcaacaaatgtggtcctaaattattgcttagcctgaattattattaactgtattttatgtaaatttcacaaagcctattatttgaaggaagccattactaaatcttgactagcgacaagtcccttgttaaatagccactcctcacatacttatttccttttttttttttttttttttttttgagacagtcttgctctgccacccaggctggagtgcaatggtgcaatcttggcttgctgcaacctctacctcctgggctcaagagattctcctgcctcagcctcctgagtagctgggattacaggcacccaccaccacacctggctaatttaatttttgtttttagtagagacagtgtttcaccatgttggccaggctggtctcagactcctgacctctagcgatctgcctgcctcggcctcccaaagtgctgggattacaggcatgagccaccatgcctggtcataactatttcttaagtaggacttttagaattggttcatcctaaagtgagataagcatacatgtatttgtgaaaatagtattcaattgagttttaatttgctcacagtattagaacacacctatggaagttttcctcatttttatgtatatttatattaaaagaaagaatgaaaaatttagtaatgtaagagtttctggcataaaattctgtatcacagaagctggaaaatttcggcccagggtgcagactcaggcactaacttgggggctttgataatgactctgccatacttctggccatgcgacctggaagaatttgttaaccattctatccctcaattgccacatcagtaaaatggggagtataaacagaacttagaacatagatgtttgtggggatgaataggattatataggtgagatacagagtactgttgtgcacacattgagtgcccaataaatgttagctataatctactttatcactatcataatagaactacagctttttcaaaatttcccaaaattttattctatggagaaaaggtcctttgaaagaactgacatttcctggatttgaaacactagactgaaaaacaaagtaaaacaaaatagaaaaagcctgtttttgtattttgttgtgttctgctttgctttactttcctcaagtactgttggaacaccagggggttccatcaagtttttattcttttgtgttcaaaagaagaggaaggaaaacaaggttatgcattggcactggagacacttttttccctaaaatgtttagaggcctagaatgtacctaataacttgtaaagcaccaactgtatttcctggttactaatcaaatttgtttctatttcatttctgagccaggaaggcagacacaagttataggtaaatgtcaggtgctttaactgacctacggcagtcaataaccagtctttcctcccctgatgaagtcaattactaatttagagaccactgtgttccttgtctcttctcctaagccaagtataccacaagtcaacaaagataattctttcagcagccaaacactagggcgaggaaatgcttactgtctgcttgctctgttagcagcaaactatatagggaagccatcttctggctcacacagagaaaagagaaccctggcactgccacagctgtcactggccttttctgtttcccaagcaaaaatcagaattgaacaggaaccaaaactattgagaccttccttctgtttcccaagcaaaaatcagaattgaacaggaaccaaaactattgagaccttcctacccacctgtgattaaatgagccaaatgagtagcaacgtggcagatggccctacagttaatgagattcttgcaagcccgcaattctgttgaaataaaattttgtcacttcagttttcagtacaaaattgtgccaactgaaccctccaacacttttctccaaaatgggaatcgtcaatctcacaagggtccattgtcagaggacaaccttcatgtacaagagtgttcaagataatcttgaattttgtaatggtctggaattgctatgactccctgtacaccagaactttcttctcacacattgatcacttcaagcatccacagtttttctttttctttcttttttatttatttatttttgagacagagtttcactcttgttgcccaggctggagtgcgatggtgtgatttcggctcaccccaacctccacctcccgggttcaagtgattctcttgcctcagcctccctagtagctggattacaggcatgctccaccatgcctggctaattttgtatttttactagagagggatttctccatgttggtcaggctggtctcgaactcctaacctcatgtgatccacctaccttggcctcccaaagtgctgggattacaggcgtgagccaccgcgcccagccacatccagtttttctagtagtttattcctaaatcaatatcctgactacagttaagcatcctaaaaatgaatgattacatttatagctgttttctttacaccttcatctatatctctaaatattgttctgattagacctcctgctttaaaacttcatcagctcactcaggcataagtcaccctgcattctgcactcttctggattttgagtccctttgaattgccactgaccatatgacttacccatccccatttccatttccatttattttttttggcacttcaacctcagtatctttctcctcctcctcatttacagcatatctccattgcacttctggccaacttccatagcacattttcttccttctgtagctaaatctaaatctgcagctgttttaatatggcatctgtggttaatttttagtacaatattgcacatattgaatggcagtaatgcccaatgctactgcaatattatgcaagacatcaaatggatggaacctattaactcattgcaaactcatgcattatgaacatggcatagcacttacctgaaacatacagtacctgtatggagaaactacaggttccttcaacgacttaagaagtgaggacatcgagcacattgcatcatcttcctgctgctgcagtgttctataattttcccacttacttgctcccaaagttgcatcaaaagaacaaagagaaaatgaaatccacaggaagctcccaaaggctgcctatttggctcagctgtctgtcgatttttctaggttatgagattgctcttggtgacttttgacaatatgagaacacttccctcacctttaatgatgaggcaaggggctccatacacataacattagatagatgagaattccacgaaaaaggataagccatccaatatgctagcatagaccaagatcttaaaataaatacatttgcattctggcagtttgaacagcagagttatttggaagaatggcactaaagagaatgagcccctttaagggcagccaagagctagattttgctagttaagcatttaatgtaaaacagaggccaattggaataatcattttgtactggaaaaaagaaacacaggctttggagtcaaacagaattagtttcaaataccagccttgcccctcagtagtggggtgactcaggcaagttactaacttctctaaatctcagttttttcacctctaaccaaggataatgcattccttacacacttcttgagaagataatttgatgtaaagcacccaggacaatgtttggtgtatagcagttacttcaatttttgaaaggtggcatacaaacataattatagcaggctttggcaggaagaggtataaaatattatcttaagaataaaacagtaggtactgaaattagacaaagacaattgaaatagaaaaaaattgttaaccttgtgaggttatataaaatagaataaaagagatcaatgaatagataaggtcagatggcaaaagataagctaagtaataagacaaggaagaataaaaggtgagagaaaagaaaagtagcaaatagattaaaatgtcaaaatacaggtatgaatggagtcttgcctttccagtaagatattatgagaacattagggaccctaagagagaagctgaagtccttcagctgacctggtaggaagaaggggagaagcataagaccccagggacacaatgcaagctacatcttaagcagactgtctgcagagggcttgagccttccagctctgaaggcgccctcggctcaggcagcactaaaggaaatgcactaatgagcagaagggcaggttgctgagagcagcgactgccgaacttcctggtcaagcaggggttttttgatttcataaatcaattacaatgtgctatattgatttcacaaagtcagcaggacttaaaaactaatgagcaaatttttttattattatttttgaaaacactgcagtgtctacagctcagcacactcggcagaaagacaaatggaggctttggctgccacagatttcattccatcctagccccctcccagccatgttcctcatctcagcatcagcaaagaatcaggagctggcataagaccctggtgcattatgccaacaaatctctccctggtatctgaagcaggggcagccccaactaatgtgtctgtgtttaggcactagtgagttttgtacgggtgcccaggcatccccagatggagcaaacaaggaaaagaacaagaaacccacctaaccaaggatataaaatacagaaggactgcatttgtgattgtggttcttaataggtagccactgccattttcttcccaaccatggtaacatctaaactggagtttttattgagctatttattttgtacaacatcaaacataacaaaattgataaggagattattctgccactcaacccctggcccaatgccaacagcttcagaaatgacctcaggtggagggaggcatagatagtttagtctttctccacagcaaaataaattatcccatgatacagtttttaggaaaaaatgcaaagtgggggataaatacattctgctaaaattttgctgttaaaatgtactacctgttaaaaatgtaccattctagggttgaaaaataattaatgttaaaaataatagctaatgttttagcacttgctaggtgataggctctatgctaagtcctttgcatgcactatgtcatttaattcttagaacaacggtaaatggtagatactattattatctcaattttatagttgatgataatcgaggcttaggtaggctaaatatctcctgagtgccatgtggtaagtgacattatgaagtctcatctgtttacactagagcctgtgttcattccatcagtaaatagttattgagcacctaacacatgccaggtactattctaggagtcatccgctaccaaaaaaaacactttttaagtcaagacaatgtatttaccagaaatgaaaatatttcaacgaatgatgacgttctttcagaatatgatttcatttattgtcaggattgagaaccagaaatccagaagatagttgataaactggctaaagggaaactaagagaataccaaacattattcttagtatgtgaatacaacaaattagagtgatgggggaacaagaaggaaggttaaaagtctaagaagttaattttttcttgcatagaggaagcagataaaattgaccaaatgtaaatatgagagaaagagtaattactagaagtaacactaaggaaataaaatctgtgtttcttaggaagtcattttgtctcacaaacacaacaaagccatgaggatagattaaaaaataaactgctacataaacttgatcttcaaaatacttctcaatgcgttcatgattccttttaatattattagagtaaatagtaaatatagcctgcagaagttttaccctcttaattttcattcctttatgctttttttcttgtatgtacttgatgactaaagtcacacttaaatgacttaagaaaatgtgctacaaagaaaggaaaacgaaaatttaaataatttatttttggtaattttcctttcactttcacaaaactcacaaataaacagaattaggtaaagacatgccccacaaaatactgccttttactgacacacattttttgctctgttttggtgctttttttttgtttaagtacaataagaacattaattcaaggtaggcacctgcctagatcccaccctcatttcctacaatcctctctcttcttcactactgttgagccaaaatatttcagttctacaaacatacagagctcatccctgcctttgtttctttgtctcagatttttccgttgtctagaatgttccttcctagatattttccttatggctgccttctgcaagactaacattatctaatacttcaccacaaaggtatttcctaccacctttatcagtcatgggtgagtaaaaaacaaatcaggtactcatatagtttatttagtaaaggggtgatttatagtaatatagtgattatttattgttataaagtttaacaatatgatagcacatataatgcagaattctgtactacaagagccagggaggagtggttaccaagggtgagagaataaaggaagaaacagttcctacagctcagaacatgaaaatataggggaagggtgcccaacaggaacctggccttaggtaaagaaaaacactgccaatcagtggggagctggcagggaggatccaggggaaagtatacccagccctcctcctcccctagttctcaaatcttctgcagatggttcccattggtcaaacacaaccagaggccagaagtaaggcagaccaacgacagagtccataaagtttggtcttctggagtggaaagcagaatggagaagggcaaagagaccaggaagggcaggtggaaatgatcatcaagaacccaatcccattgcccctagtcacttcctaccacattctttctgtttgtttatttgtttgtttgtttgttttttgagacagagtctcactctatcaccatgctggagtgcagtaccatgatctcaggtcactgcaatcttcacctcctgggttcaagcgattctcatgcctcagcctcccaagtaactgggattacaggtgctcgccaccacacccagctaatttttgtatttttagtagagacagggtttcaccatgttggccaggatggtctcgatctcctgacctcatgatcctctggccttggcctccaaaagtgctgggattacaggcgtgagccaccatgcctggcctcacattccttcttttaattatttgcattgtacttacaattttgatattttctttttagtttgtgcatctgtttaactaactataaattccagatttgcctgtctggttaatcagtatgtcccagagattaaaccagtgcctgtatactttagatataattacttgccagattaattaaaatagcaagactgctgggcatggtggctcgtacctgtaatcccaaggctttgagaggccgaggcaggcagttcacttgaggccacgagttccagacagcctgggcaacatggtgaaaccccatctctactaaaaatacaaaaattagccaggcatggtggcacatgcctatagtcccagctactctggaggctgagacaggagaatcgcttgaacccagtaggcagaggttgcaataagccaagatttcaccactgcactccagcctcagcgacagagcaagactccatcttgctaaactaaactaaaataaaataaagtagcaagacctctgtgattaaaaacaatacattgaaaaaactaatcattcatgaggaaatactctgtagtttataggagaatgatacaaaatgatacctcattttacctgacaagaattttagaatgaatcaactatagtcaactataccttgtaagtcaacttttacaactccatggctatcaggctaatcaggttgatttatcatatctagcaaaacagagatcatactacctatctgcagttaacatggcagttaaataacacatatgatagtcaatcatttctccatcaattaatctattaatttaacagatgtttattgaacacctactatgggattacactagacactgtgaatacagaagtgcaccaaatagccaaaaatcactgtcttcatgaagtttatatttgaataaggagtcaaggtcacatcgtcagaatgggcctcactaataagctgatacatgagccaagatctgaaagaagcaagaagaagaaaccaagcagatatacaagattttctggagagaaagaatagcaagtgcaaaagtcccgacgtgaagtccttttagcattttagaggacagcaagcaggcaaagttgtctagagccacgtgcgtaggttttgaaacacggacacagggcaggactaagggagagggaagcagaatatgttgtaaggacttaactttttctctgaatgaaacgggtggccacaaagtggcacatgacatgacctgattgacattgtaacaggggagcaaggcagaattagagagacagttataagagtatcacattgattcagatgagagatggaagaagtgatcatagtctgtggacttatatttgaaggtagaggtgaaatgatttcttgatgatagaatgtagggctgaagaatcagaaaggagtcaaaaaatgctgaggcttggggtcttagcaatccgagatgcccagaaagactttgttatttgtttgtttaatttattttccagttaactctgaaaaagagaggctcatccagttgttatttacctcattgccatgaaaattcatccagttactactgtctcattcccaagaatcattgaggaaatgtcttgtccttaagctttgtatagttaactttggaacaccatttttccattcaaagacttaccattacactttaaacatagaatataaacataaggtaagatgctggcaaaataaaaattatgaactacttcatttctgtgaatttagctcatgataactaaatttggataaattttgcaaagatggattttgatccagatttaagatttaatcagtggctttacaatttaagttagtttacaatgaattaaaggaactcctttttatgcagagggttttaaaaaatcaggttttcaatttttcaaatgatcttttaaaaacatttctatcataacaaatgtgggttaccaaattataaggaattagaatataatcatatgctttagtatcaaaactttatttaatataatttagtctttttgtcaataatttattattctttaggatggcagagactgtatagtatcatgaaggaacacaggctttgaagacagaaactaagctcaaatttccaattcctttgtaacttgctggcatcataaacttggatcaggtttcctaatcttcaaactcaagtatcttcattgatttaaaaatgatccccaaaataatactacctcacaggatcattgaggtaggattatattcacaggattatattcaagttttctgtttgtttgaatttagctcatttggaatttactaatttaacagagattatgattttggtagaaattcatcaaagcaacatttaagccaatacaatgattttctagctattacacaaatactcatctaaagttaaagtatacatcttttactgacattccacaaactcagtcattcttactgagtggaaaagctccaacttctgtgtattgtgtgtttttatttggcagtcactttgacaattttattctgaatttaaatctatttttagacctgcatgcattattttatatagtattgtgaagaagctgatatttttgtttgatacactatgttatgtcagtgcttctgattgccaaaaccaacagttcatgtttaaaacctttcagaacattctgcagtctgattaggtcacctctgaatactaggaactaaaatgagaccacagctaagaagaaaggagacaggtgcaatttttttcctacttattctcatttcctaataataatataatcaatagatcattataaacctctttcctgaaactctgccctcctccctgtttctctccaccctacacacacacacttaaatacaccgggttcccctatttgctccactactcactgaaggatcatcttcctcttcatttccttacacatccgggtgcttcctgggctttggtcctcgatgtttcctctcacttaaaaaaaaaaaatcccttttctacctctcttttatcagtctcgttacctctcatagcaagaaaaagtgtttttttatttcctgtatttcctggaaattgtatctgttttactttgatggctcttgtctagcagcaagaaatgaagaatccgacttggagtaaaatctttttgaaggtaatgccaagcccttattcctcttctttctccaattgactgtagcagagggccctcctaggggtcaatatttaactctttaattaatcaactgttattttagaatacagcataaagttctcacatatttaatatatgtcaacttattccctaaaagtccacagaaacaagcattgtggcagaggaaaatttattgaaaaatattgttccaaaatcttgcttcttgattatatttgtaggtataacagaattagactactttaatagctgaattcatttttatttcattgtggaataaaatgagtgctgcagatgccacactatggtttgattgttatatatgtttggtcatgtgggattagcctgatacatgtatgaactcaaatatccatgttagctaacaaacaaaaggagtgggtaaagagatgtgtatatatatacatactgaaagaactttttctatatatgagtgaatagcttacctaacgtaacagtctttacataataagactacttatttaaattttaaaagaatttacctctagatgggtttttgagtgaatttcctcagaaaattcattttcatggcacagaggattatcatacttggctgctggtctgagctcatccaggaaacagacttgagtgcttttattatccactagagtagatctcaaagaacagaagttactctatgattatttagcggcaataggacttaccacagttcctggcatttagtgttcaagaaatatttgttgaacttcattaaaaaattaagatagccacctcaatatcttagtttatacacacattttcaggcacatatatattatacgaagagaaatgcaataataatccttgcataaaacagatgagaagctcatctcactatgagatgggttggagaagtcttcattttctttaagagtttatactcaagcttgtcagtagacatcattaagctgttatgagattccttctcttgctcagttgaatctgcttcatgaaccaagtcaggttctcttccatggcaaaagtaatgaggtggggccaatgtgtcccattgtctcccaatatccacagcagccactcaacactgtagtgctgtggccaggtgaagggactctgaaactgtagtactatcctttgaagctaccacagttcttctcctctatgctgaattaaccacatccttgtttccatttaaataagaaagatgcacagaggttcaacccacccattattgaacatattttgcatatggaatttctaatcaccatattattccagggatgtttgcagacggaacctatttagatttttttgtacatggatgcctagagaattatggaaaaaactagaaatcatctagttctagtctaatacccacatttagcattcaaggtaactgagaaataaagaggtcaaatgttgctcaagatgactcagcaagttaggagccagtgtggaccagataagtgtccttttctctacaccatgtggataatggatgtttatagcaaagttaacattgaacctgttgagattcatgtagataatctggaattttatgtctcactacttgataatgttcataaattgaattatgtaaccaaaatctgtcctttaccaatacagatatcctattcaaggaagtaaaatttcactagtatcatgggcatctttagcatgtcaatttcagtagaccaagtagaactctagttaatttgttttgaatggtgaggcaaacaaagcatcattattcctatgaacatttaacagtttttgagtaatcatgatggcatgtattgaacattttggtgaaacaaatatctgctaatgatggaaatgtatttgctagtggtacaagtcttacaagacacgctgcagaagaaccttcagaaaataacctctgaccttgaagaacagatgttctaaaagcacacaacataggggttttgtaaatgagcagcactttggagtttttccaacttttcaaacattcagggaagtaaaaatgtcactatgccaggttttctaaattttcatatttcaaattagtataatttgagggaagttatttaaatgatctgcacattacttatcaagacatatatttctaagtgccaatgtccaggaattagtttgcttttctgaaataatatttaagataatcctttttaaaattaaaggatattttatcaacataaatagcctactcagaaaattatatcaacactaaatcacaggtaacaccatcatgttttatctctatttattttgatttttgaagtaatttaaaagggtatatttaaacattataaagtacactaacaaataaaacattttgtagactcagtgaaaacaaatttatttatttatttagtttttgagatggagtttcgctcttgttgcccaggctggagtgcaatggcgtgatcttggctcactgcaaccttcgcctcctgggttcaagtgattctcccgcctcagcctcctgagtagctgggattagaggcatgcaccagaaaacaaaatattttattcatcattagtaacatttgccagaactctgtgctgtttaaacttcataaagtatatcacatgtaggatattttctagttttctagtctcttctgtatatatgccagaataatatcaaatactttcatttaatcagttatgattattttataccaaagaaatctcattctagaaaagaaggccatctattcaccactcctgttggccattaaccttcatacctcccctttcagtgttctgtcttgggtcttctttcaccgtataaatcccagggttgatttgatccagtcactctgcagcaaacatccttgtatgtctctttgtgaacgtcaacaattaggatatggacttcctcagccttatcagatgttgccaaattgctctccaaagaactaatatcaatttacattccagccagcagtgaatgaaagttccagtttctctacctcccagacatatgtattgtcatgctttaatttttatcatctaatggctgtgagatgcaattttattattgatttaatttttatttccctaatcactggtgaagctaaacatctttttacatgtttatttgtcctttggttttgcacttctgtaaatcaactgtttatatcctttgcctatttgttgtttctttgagcttctccctccttctccttttcctattattcttcctcctcctcctcctccactcctctttctccttcttcttgttcctaggagttcttagtattatctgaataaaaaattctttgtcagttctagttttatgcattacaaatatgttcttccagtttgtggcttgtcctttactttttttttaatggcaacagaaatttaaattctaatgaataaatgtatcagtcttttcatttaacacttaatgccttggatgaaaatgttttatcccagggttatagaactattttcttaaatgttcttatcacagttttaacattttgttgatcacatttaagtctttaatcaatctgttgtttgtattttttcataatgtgaagcaagaatctaattttaatttttccttatggatacttctcatttattaattaatccactagttcttccttcttctcaattttaatgcctttttagtgatacaacaaggcttttatgagtgaggactgctttgaggctttgtatcctcttcaatttgaccatttttgtatcccggtactattattatactgttttaattgttatagctttataagttttttggattggtgtttcagttatttattgctgcaaaacaaaacagtggaggttttctaaaaaatcattattttccatgattttgtgggcagccacaaaattccgtttcccatggtatcagcccaggcactggacgatcatgaggtccaaaatagcctcattcgcatggttgactaccacagtgctagctgacaaatgggagctcagctggggttttcaactaaagcctttgtttttctccatgtgggtatctctatgtggctatttgagctttggaaagcatgataggtgggatccaagaagaaatattacaaaaagcaaaggcagaaattgcagatgtcttaaagtctagcctcagacatcactcaaagccacctctgccttattctattcctacaagttgattaaaagaaggtaaagtagactgcacctcttgatgggggagtggcaatgtcactttgctaaaaagtacctgggaaggaaaatagtgttgtgatcatctttggaaataacaatctattgcattctggcaggacaagccttatcatttcattaggcttcttcaacaccattttggacccttttccttccaactatgaatctataaattttagaattaacttgtctggttccatccaaattttataatgtgatttttgagtgaactttcagataacattcttcaacaaatgtttattgagtacctactatgctcttgcactaatgatacataaatgaaaaaaaaaaaaaaacagataaaacctccatctttcattgagcctgtatttcggattatgtggagaaaattaaaatatttatgacctttgttattctaataaatatattttgttttgcaaatttggttaggtcttcttttatgtccttcgtctaagctttataatttcttcttatccgatttattcttagacaaatttttgtcttgtttctcccaacatttagactaagctctttgggcaaatgttttaactttttgtcttctgatagcaccaagtacactgccagatatagcaggacaatgtaacttggtgaacagactgaataaaaactgaagtaaaagatttaattttccatttgtaaatattaatcatgccaggtcaaactatcttaaccaagttaagctcctagaaataagtagcattcatgtagtaagtgagttgccatcactatattcttatagaaggtccctcgtataaaaaccagtaagtaatgtaaaggagcaactacccaggtactccagtggttaaaaggaaaagatgaaaagaaagaaggaagaaaggaaaatgctctccaagctttatacggacatttaacgtagttaaaaatgggtttgcctggcctttgctaatcacacctttagctaataacttcgaaatttgcttctacattaggtacagtgtggaacaaattagctcacttaataaatggaatgaagctcagtgtgagtctctttaaaagcacaagaacattcctatttcatccctcaattaccaaatatctgcaattcctagttttgcatcatgctgaacttctaaagtaggaaaaaagcagttgaagtaatattacaatagcaaatgatacaaaaatagcattaagtaccaaggatacctaaagttcattatttcaattctttactctcaacaagggcagatctgacactgtgaaaattgctgacaaaatcatgacttaccaccaaacagaattttcaacatttcaagttatgattaagataaggaatagcttgatgactatttcactacattcaatactatttatagaatacagctgcagggctttgtatatctaataattattgtgaagaagttttacaaaacatcagtcctttgagaatttctatacattgtacaagttatttaaaatctgccaaatgttacaatatgaaatgtaaaactaggaaacccaaatgcaacaagtggaaaacatgggctcagctaataccacaacacactgccaagatggaactctccacaaggtctatcttcctgctacttctgtcctggtatttcccagagttcatgccttctcattccaagtatatgctaaatactcctaaatctagatctctagcccaagatgtgtcagttgagcaacagacccatgtttccaattcctctgaggtgtcattgcttgaatgtcacagaaataatgcacattccataatctcaaacataacccatgatttccatactctcctccttttgtatttctctctccgtgaatagaaccaccatccacccaggcctctatgacagaaccttgggtgtcactgaagacactttttcctctctgttacttctcatatcaaattggttaccaagtcctgggaattacacaggatctcatctttttccttttcttcatacccactgccatagccttggttcaagtcctcatcatctcttacatggcccatggtagcagtcagctagcaggaccccctgcttctagatgtacctcttttaatccattctccaaacattcaccaagtgatctttttaaaacacgaagcagataaagttacccatacctacctgtttaatacctttcaaaggttaccaatattcttgcaggataaattacaaatccttaacattattccctggctcttgtctacatctctatatttttttattaagttcaggttctttcctcatctgctacctatccatgccagacaactaagactcagactcagtctcactaatttgtagctttgcttacactgctccttctgcttaaaagatcttcaaatcttctcccctacttgcctttaacctgatgaatttctactcattcttaaggtctaatacaagcattactgcctctacaaaccttcctgaaatccacagaggaaattatacacttccatctttgtttcataaatctaataagaactaatatttatggagtactgatattgcattagacattgtattcagtggtttattacattattgtatcctataaacataaattattttcacattaccttactattatatcctacacaatcacttgtaaattattttagtacgctttattttacctacttatttacatattttgtaatattatcctactaaactgaaaactacttaggactgaactgtggttcatcttactctctattgcctaagctacttcattgcacaagtaggtctcaaagctctgttgataaatgaagtttaatggtttcaaggagactgatattatataattagagatgttaacaaatgcattaaaaattttaacgcatcttgaatcaaagcaattatctatctaacttagtagctgtgcaacaaagtaaaaagagcaagagtgccattaatatatctcaaagataagcttgtttaataatgcatgtttgggctgggtgcaatggctcacgcctgtaatcctagcactttgggaggccgagacgggcagattgcctgggctcaggagtttgagaccaggctgggcaatatggtgaaaccctgtttctactaaaatacacaagaaactagccgggcgtggtggcgcgtgcctgtagtcccagctactcaggaggctgaggcaggagaattgcttgaacccagcaggtagaggttgcagtgggtcaagatcgcaccactgcattcagcctgggtgagagagtgagactccgtctctacaaaaaaaaaaaaaaaaaaaaaagcatgtttgtgtcaatcacttatgtgtttatttgagttaattagcgcctatgcagttttctgcttgctcaacttattggaaaaaaaatttctaagggtatgtgcaaaaatattatctaaagtagcatttgaaattttgctctacaattacactgttaaacacagtaattctaaacaattccatgtgaactaacatctgtaaatgttcagcaattatccacctgttgacagtctgtaattcagctttgtgagtactactggtttgtgacattaaatcaagaggtttaatattttatcttggattaaatgcaaaagataatcaagaataagacagacatttagctgcctggatagcagttatagatctgtttatattaatactaacagagagtcaaacagttcccaaaacttttagatgtgatggcaagaataagagcagaagatgatctgcacatcaaacagctttttcgtctttgcttagtgtcaagcatttggcaaaacaaccctttgtattatttcagcatttcagaggcctaattttccatagttgtgactcacatatcctattcataggcagaggtcttataaaaatgaatgtgactgatacaatctcttataaaaatgaatgtgactgatacaatctgagcaggaaatacttattaccaaatgaccacaaattctttcttgtttgtaaaaattaatttacctgtgttaaattgttttaatcagatttcattttaaaactagcactttaagcatgatttaatctaacaactgataaaacaataacatttcaaaggcatatctagaacagtttaaaccaaattcttgtctgttcataagctctggtaaaacttttagatccctgctatttagtaaatctcttaatatgtattcatgtaactaaatactcctatacactgttttcctaaattcagggttctggatgttcttcccctcattattaggacaccatctctctgttctatcacatttcttcccaagcaagtttgtcatctaaatacctcattaaataatcttataccttattccgtcataacaatctataagagaattgttccccaggcagaggaagtcctcaaatttgttgctatttcctattctcttcttaattagtggctcaactatccacaaaatcacccaagccagaagcctacagtcatccattccactccatccccacactcctaattggtgattaagacctattgactcttcctcctgaatatattgcaaatctatttgttcctcttcaagttcactaccactgcttcatcattcatcacttggattattgcagtgatttttctaactggcctccctgcccaccaggctcagtttcatcccctcatttctcccccattccagctcattcttctacaacaattgtaattatatttctaaaatgagatggctgatgccattcccctacataaataagatgcaaaccaaattcctaacacggcattttagcacagcctttgcatatctcaccagatttatgtctcatctaccttcccatatactccagtgctacaattctttttctataagcagaaataagtgcctccttactctatgtttacttagcatacactgttgttttagtactagttgcaggaataaaattcaaaatagaagatagaacaatattttttaaagcacaagaagcatagttaatgtaaaagcatagcacaaaataaaatgtagacataaatcaaaatatatcaataacccaataaatacaaagggactaaatttgcaagtaaaggacagatattgcaaattatatttttatgctttttgcaagacacacaaataaaatacaatgacacagaaaagttgaaaataaaaagatgaagaatgacaatgaacagaagaaagtgagacacttgtagagaggcaaaaaaggcacattggaaataaagaagtttctatggaacaataaagaaggaatcagcaaaaaatatagtaattccaaactcatatgtgagaaataacattgtccagaatatacaaagtaaaattgagattagaaagagcaattgtcacagatcaacaataatgggagatttcaatgcacttttcttataactgatacatcaggcagcagaaggcattagtggattgtgggagatacaaataatgcaactaagaagtttgttccaatggctatatgtaaaaccatggaccctacaattagagaacacacattcacttaaatacataataagctttaaaactgaacatatacataaagcaaatctcaatcaacaccaaaaattcagtatcactcagaacttctgtgcatataagacaattaaattagaaatgtatttattactattttagttataaagaaaacggaagacagggcaaaagttaataaaattggaacactatagaaacacagaaaaccctcatatttcaaaattaaagatatttgtactacttttatttatcattttcaattgatggtttgcactcaaatatttcattaagacttcagttatttcaagaatttaaacatgattttatgcattaaaaggtatcagttaaaagacctgtgactgaataaaaatgtaaatcaattaattaaaaataggcattgctaaatcgacactggaatctgaaattatcatgggccttctgcctaacattttcaagaaaaaacttgggattcctgaaaaaaatatataatcaaggataggtaagcatctaataattaaattaagatcatcaatttgtattacacagaaaactgggctgttgtcatcttgtatggatcagaacatgattatgccataaaatccattcttctagcttcaatcactattgtctctcttttctaactatagaggtgatcagacagcatgcatcccttttaggtcacaaaagaaatcctattaaatgccaacctataaatggtgcttccggaaacataaactagatcagggttagtttgggatgaaataggccttaacttagatagaaagtagaaatgaataatgtacatttcataagtctttaagcaaaaaacaattggcaattttactgtattttatcaatttatcttagttgaattttatatcactgacagattacttgaccatcaatttttctgatttgtatactaattctagtcttattttcctaaaatgttttcctaataacagcaatgtattcagaaattgtaattaaaagtcattgaaggtcatctgatttgttgtgttggctttagatcagtgactagattttcccagtcactgctctgtcagctttaatacaatgcatccatttgtcttactaacacttcaatttatgggatagctgtttttcacaattaaaactactgaagctttagtatacatggaaatgatcatgatagcattttctccatatttctaacaactctggaaggctctattgtaaaaatatagggccttccagatgactagatctggtttcctgaagacagcttttaagattgctatatgagctcaagagaaacatttacaagaatctttagataaattactaagtgctgcagaagtaaaaccatttggaatagatttctaaactcctcttacataaataattggtgagtgattgaggtaagaaaaggctgcccttactcttgctgacccaatagacaagacagctgatgacgaaagttgatggcgaattggcacaagaaggttaaatgcaggagaaatgaaaccgatctacttattgtgatgatgttgactgctacctagttagttctatgagagacaacacctacttacacaaggtcttccacttaattgggcttaaggccagttcagtaatcacaaaattacaacaagctaaaaattacaccaatcacctcctccaacctctgtatctataaagaaaccatgaacttatataatttacccaggaaacaggagtcagatctgctgcctcctattacaggagtctttacattcaattaaactgaattagatatatgaattcaatagaagaaatcttgatgtaaagtcaattagtataaatacaagtcctccctcaccccacacctgacaattacaataaaattctatggggagcgcattatgaagagtagagaagaatgccagtgcaattctgtaaaagctaaggcaatctgagaatttaattttggtatgtctagccaaagtcaattactcatgaacaacaggctggaaagtgaccaagggctgactcagcagctttcaaactcttctgttgagtttaaaaaataaaatgcgaaagtagagagagaaaataggaaggaatagtccaagaaaggacgataaaaattaaataggccaggtgcagtggctcatgcctgtaatcccagcactttgggaggccgaggtgggtggatcatgaggtcaggagatcgagaccatcctggccaacatgatgaaaccctgtctctactaaaaatacaaaaattagctaggggtggtggtgtgtgcctgtaatcccagctactcgggagggtgaggcaggagaatcgcttgaaccagggactcggaggttgcagtgagccgagatggagccactgcactccagcctgacgacagagtgagactctgtctaaaaaaaaaaaaaagaaaaaaaaagagaaaaaaattaaataaactaataataaaatcataaaatctgggctgtgagttcacttctagaatgctaggtactcatggaaatttacctaaaaccaaaaaggtgaagtaggagctgaagacaggggtgggggacagaaggatggggaaatgggaatggggggcacagacaggtggaaaatttagaggaatatagaatttttcaccagcttgaagtaaaactttctaattattttaaaaaaccttataatatatcattactatgtagaattaccaacagataaatttagtctttaatactcaaaaagaataattttataaagaaagttaccacaagacaactttagtggatcctaattgtattcataatgcaatttacaaaactgtgatttacatacatcttgtcaggcacacatcaaggacacaaaaggcacactcacactatctcaaagcatgtaataaaaaagggtgctataggaaaagaaacccaccagtttctactgactgtatctcttccttttctttctgtttagccttgtcatcattaccaaggagcttgctcattcctaaaacacatttgctacaaccaggcatttctctttcagtcagggcttcaccatggctgggaaatagacattgaggaagcagagagtgcagaaatgggtatgagtcttagagtccgaagacctaggttccgaggaggtcaccgtctggttgactgaccatactcaagctttattaacttttaggagctcagtttcttcacctaaaaaaatgagatcgttggattcaatgatctctaagctctctgacttgaaatggattcaattcactaatttcccctttttgaattttcctcatattctcttaaacagagtcgaatgggaagctttttcaaaacaataagtaattatttcttatctataatattctacttatatatcaaactgccctcgcctttgccaaagccctcagtggacaaataacttcaaataactactaattctcagagcagtgcaagtcatctaggatcattgtttacattctatacatattgaaaggctttctgtaaaagtgagaaatgttttaatttttaatgataggaaaagtaatgctttctacaaggttgaatctaaatccaagccatagataagagctactttaatttaactggtatttatggttgaggagcagaaaacaaaaagaaaaaaaattcctttgaaaatgtttatttatgacagtctaaattactcctttgacacaatgaacacaggtaaattatctcagagctgtgtttaatggctctaatggctagctgggtactgggccatgtatttcaggatgcctacttgtttataaaacttgtttccaaaaatcaggctaatatagtactaagttaccaagcagaattttttttttaattccagagtcactggccatatttcatatataattgctgggttaaataaacacaattaggttttatttagcatgtatttgattatgaatgtcttcatataaataaaaaacaattttttaataaactagactaggaaaggataaaaacttagtatcattattattctaaacataccaaggctcaagttttcattacctaaaatatactcttcgtaagacttgtggctgccgaataaaatacattcatcagatgcagtattgctttcacggtaattatgatactatttataatgccatggttatgttcataggccactaacaaacatatgcagtcttttagctacaacactcaaacataattacaatgcccctttccattgaaataatctatgcatcccgccacagtgacttcattccttaccaggatgcctgctgaatcagactgccccaattattcaggcacagtgcctatgcttatgactaataatattggggaataaacgaaattaatgtccatgacttcctgaccattttggccaatctcctttctttggtgtcttctgctttaaccctaatactgagtaatcttgaactattcctggcataaaaagagcttcacatactgtacaaagtcttcaagccctacaccaatatttcccatagtatgttccaagtatttcagtcttaggggatattgctcaaaaaaatcagagtgcggagaggttccaagatcgaatacttttgggaaactttgcatactatattcccaatccttaggattctcctaatctattcatatactgaaggctcttataagtcctgaagtaaagaaatattttatctacatttaactcacgcaattgcaaaacttacttaaccatgaaacctatttcatattactttttcaagtgagtcttattaacataaaactagtggcaaatatttgggtgtccctgtcttcatgcagaatttgactgcccaggtcctattcctctagagactagttagattctggccagttaactggagaaatcaatacaaattgagaggttaattttgttaatagattcatgtgttgtctctagcagagggtggttgattttaacatacatttgcaatgcatcagccaaagtgcagcataaaacggaagagaataaactgtgagactataccttgcacatgttttttattgcatgagtaagttctatatcaggtctggaatttctgtactcaaaggacttatattctgaagcaacaattacaaatattgagtggaggtaatatttgtggacattgaatcaaaccagttttctcacctaacataaataacttacctgcattttgatgttaaaaaaaaaaagccacctgccaagatctggctgtggagccatggctgtgtatcagccatgtatttgagtagtgacaaatacttaattaacagggtcattgaattgagaagaaggcctgaattttgatttctacaaaaaagtttcagagaaagatttttgctttaaaagtctgactctttataaaatttcttcctgtctttaaagaaagtcaaaacatggacaaaagccacaagccacctatcaatattcatgtgaatcaaaaaattaaatggtaatgatgaggatgagaaaaggagagaaatgtatcttgcttccctgttaaaatgatgacacatgtaaggacagccccatggcatggtgtctgatacttcatctctgttagctttttcttcccataatgcttcttccctcaaaaaatgctgatcacagaaattttgaaacacaagatatttgtggctttttttttcagtggaaaccatcattattgcctgtaaccttgatccgttctaatagaggactacagaactaatcctacaataagtcaagataactgatggcattggcaagtagttgaaatccttagtctaacaaatactgctttcaaaagactagtatactcactgataaatgcctttttaacttatatcatgtcaattatttgctattcattatctttataaaatatttcctggtttggggaactctgcaagtttcttgtttctgatgctttgtttaaacatatacaactatgtatgttcagtctgacaaagccaccacttcctccagccaaaagggaaataactctagtagaacgcagtattttaagaacagattttgttgttaggctgtattacccccaaagaaaaggacaaaattagtaagactgaatttgttactatttactcgccaaaccctcaaggtagtttcatagagataatcacaaaaacaggaaatagtacacaatgtgggattggtgtttttcctacaagctccttttcctatggattattttttttccaatggagagaaatgcttttttacctggataataaattaaaaagtggtttcttgacattttactgcttttatttattccatttaaagaaaatgatttccaaagccagacaatggtgctgttcaatagaaaatgatgacctttaattaaaactctgccccttactaattttcacatctttaccaacctcctcatcaatgtggaagaggcataattgaagggagaaaacacctgatctaaatacactttatctaaatcacttcccccaagcagacattctctatctcagttcctagttcatttccttcattgtatttcctaattcaaaattatttctttcttcacctgttcattgtgcctgtgatcacataggccataggttttatatgggagggagctttgtagactagtgacttcccagtgttattgctgaagaaaggaatagataagggaagaggaggcaaaggtgaatatatctgatgaatcggaaaaaaaggtatgtggtctcaaatcgcaattaatctctaaatgtaacaagcaaaagcaaaagtaatgcttttgtttattttactccatctttttttttttttttttttttgagacggagtcttgagctgttgcccaagctggagtgcaatggtatgatcttgactcactgcaacctccgcctcccaggttcaagtgattctcctgcctcagcctcccgagtaactgggattacaggtgcatgccactatgcctggctaatttttctatttttagtagaggcagggtatcaccatgttggctaggctggtctcaaactcctgttctcaggtgacctgcctgccttggcctcccaaaatgctgggattacaagcgtgagccatcgcacccaacctactccatgatttttttgattatttattttgaaattattcagcatcttatctcattattccattattacagtaattatctaccacctgttgaacagtacagtgccaggtactttacaaacaactttgcaactatcttgcaaggtaagaactcctgtgcctgtttcttgcagggaagctgagttgcataaagtgaagccacaaagtcacagagacaggaagtggcagagtcaggatttaagtttacttctgcctgattccaaagctgtactctcttctctacatcacaccacttaactattaagtggtgtgataaagaggtatgcttaagcctcttaaagtatctgtcttaccaaattgctaataaactttgcaaaagtcgaagctagaatctatccccctccaccccttctctttctccctctttctgtgctatgtatatactactctacatcttgaaaagagtaattttatcttcatttgctttgtagtttattcaacttctatttccaaaaacttagctttttcctgggacaaatcccccagatgttttctattctcttataacttcaacctctacctgctaaagtagaagtctcaattatttaagagattcagaattatgtattataaagtttacaaattatgtaataaaaatttaaattcatttaaaacttgagtaattatgatgccatcagcacactataagatgtaaacattttaatggtgaaatatttaaaataaatatctttgaatgttcaaattctgtttgatacatttgttctctttatttcctcaaaattacagtcttaaatttttttttcttttgagatggagtctcactctgttgcccaggctggagtgcagtggcaaaatctcagctcactgacacctctacttcccgggttcaaggcatcctcctacctctgcctcccaagtagctgggattacagtcatgtgccaccacgtccagctaatttttttgtgtttttagtacagatggggtttcaccatgttggccaggctgttcttgaactcctgacctcaaatgatccaccctgctcagcctcccaaagtgctgggattacaggcgtgagccaccacacccagcttacagtcttaaaaattatgtattgcttattggttcttcactgtaggttcaagagcattgtcaattatgcctctgtgactcctaaaccagattttaccttcaaattcttgggtgtcagttcctgtttagcatcaacacattgaactgaaattagactgtgactcaccatgtatttccaaggaattaacaaattggctctttttcctctcccactatttggatattgaaattaaagtagctaactttaaaataatttcttgatttttaaattacccttgaccaactttttattggcttcaatctgactttttttttttaacataaaatagcccttaaatgtatacttatcatgatttttttcatttctaaaataagagataaaatatttgacaagcaggactttcacactgtaggcagttcaactgccactgaaactttaattaggtcaaacttggaatctaaaatcttaaaatgatatccagtaaaagggaaaacctgaaaacataaggtaaaggcttttttctgaaacccttgccagtgtttccctgtaaatgttacagccttcaaagaccactcaacatttcccaccattttaaaatccataatttattacaaataagtatagtagaaaggttctattccatactgaatatattaataaaaatagtatttttaaaaaaaaagttcaaaaaattgtcaagtaactcaaaagttacacataacataaaaaccattcacctcaaaatagccattatttcagatattttgataaaaatatatacaaaggaagctacagaggaagaaaggccaacaggtaatgtggataggaactgaagatcagttttgttaaaatggactcaagctacccacactatattaaatatatgtaccatattaaatatagctatacttgaattaatcacagtataagaactttaaatgaaattaatgaatttactaaaaaatgagatgtttcttttttcttgtttttttttaatgcccatctttatcctgcagtagagataaatgtttcttaacactccaaaatgtattgtgtaataaaatattgatgagttcaggaaaaacttatgctttaaaaagttgggaccattacttgctataaaagctgaagaaatgaacatattaatgttttatcctaacttccatcaatttgatattatatttttcattgttcattcatagtttctattttattcaataaccatagtgctcatggtttttaattttcgttctgaatttacattgattaaagatttatattcagttttttagttggaatccctccatacctgaattgtttgtcttgattcacctcttagtaggctgaaattcactacagcttttttgtttgttttgttttgtttttacagggtggctattcaatttttttttacttataagaacaataatgtatttgttcataattgtgtgagttagcaaggcaattctcatcggggctggcctggctcatctctgaagtcatctgccagttttgaaggggattgatggtctaggatagccccattcatttgtctggctcttacaagcttgttggatttagaagccccagctaggatagcacatctctgctccatgtagtctttcatcctccagtaggctagctcaggcatattcacaagtggtagcctcaggattcaaaacagcaaaataagacagaaggccccagtgcataagaatctttttaagtctttgtttaccttattgtttttcagtgttttcttgttttaattttccttaatgagggtttatactatcttgtgtaacttcttatgggcttgaaaatgtttgtgcatttgaatttatatttaaaagataacttgggtgggtataaaaccttggtatatactttcttgtactcagaatttttacacataattctataggattttggtatttaataaacctgtgggaaaactaacctcatttttctctcttccatgtgacttgatattcatgctgaataaacacatacatgtattcattatttttaatatttattaaccttaccgtgatacagaatgccattaaaatcatatgtaagtctttatttcaggaatttatcttctactattttaatattcaagaatacaaattatatttatattggatcccttttttttcttttccacatctttcatcttcccataataaatgttgtgtttttgtgcatttgaactaaattttatgggatttttttcaaagcttttctccatatttctaacttggttttcagtcacatttattccacttgttgttattgcttctaatatttttgtctatgaaagctttcgtgtttctctcccatttctctcctgatatacataacctctttcatctgtttttcattgaacctctactttgattctcatagatattttttcaggctttttgtttgtttgtttgtttgcttgtccgtatcatatctagtataatttccctgagcgaatgggtaatttttatcctaatcttccaatgttttttgggaaatttctcttgtgatttttttatacagctctttgttgtgttattatctctttagtctcctttctatttgatggttgtagattgagagaaaaaacaggagcagtttgcagtctcttgtttctcttgctagacttttttactccattcctctgtcaccaaatctcttatttccttttcccaggtcacacctctccatctggagtgagtggctaaaaacatatccttttgcatcagagactttctatgttatggtttgtacgtactgtctcttcttccttcttcactcctcttcatctctggcattctctggttctgaaacttggatctaagcaagaaccctgtcattctagtatagattcttcttcagctacctgtcctggaggctttagggattcaaacttgtccttccattactatatatctcttccttctgagtcagggctctttagaaccttcaagattgtgactcttgcttttggagaattatttatcatactctaactagtactatggcattacaagaaaaataaacacacacgcatatgcactaaagcagaagattacacatatcatttataaatacatattgttctttagaaaagttattattatagttatagcaactaacatgtctcataattgtatgtaggcaaatatacctccttcccacattagttagaataatctttggatacagtaacagaaaatccaacaatgttttaaaattgttttaaaatatgttttaaaatataaaagggtttatcatttacctttgaaaataaaaagtcaggaagtagtgtcacctaatgttggattgctgacttaatgatgcctaatatctctccaattatttttggcttatcacctcatagtccccagatggctgctatcctgtaggtattagatctgtgctcaaggcaagaagaagagtggggggagcactagctacaatcatcctcttttaataagaaaacagaagcatctttaccaccgccaccaccactatcacttccagcaagtttctgctcacatatcagtagctgctaggaattttccaatgcttttgtatagccatgcaagaaagaagagtgttagcaagagctttcgactcagccaaccaacaatgtttgccataccccaaatgctgaactcctccacagaaaggatttgagcatatccatatttgtatgcccagttctcagcagagtttgacatatttgtagatactaattaaatatttgtcaaattatactcctttatggttaacattatttcttctaaacctaacaattgaattgacattttcaaaaacacatttaccatgaatcttagacaactataatataatagagaatctacaatataaatctataaaatctcatattattaaactgaaattaagattatttgtcaactatgtcaatataggccaggcgcggtggctcacgcctgtaatcccagcactttgggaggccaaggcagacggatcacgaagtcaaggggtcaagaccatcctggctaacacggtgaaaccccgtctctactaaaaatacaaaaaataaataaataaattagccgggtgtggtggtatgtgactgtagtcccagctactcgggaggctgaggcaggagaattgcttgaacccagcagacggaggttgcagtgagccaagatcatgccactgcactccagcctggggcagagcaaaagtctgtctcaaaaaaaaaaaaaaaaaagctagcctgttctgtttttaataataaactattcagaaggttacaaattcagtagaatacacaattgctagtgaaaaaacagaaatttacccatagagtgcaattaggaagccagaaagtgctttacagtgctgcattgtctttctggagttaaacttaaaactttactgtcaatatttatggaaactttcattctattccataacatgtacatgttggtgataatataaatgagtattttttccctaaaatttttagtagaatttcaccctaggctatgtgtaactttaataatgatgatgataatgatgacgatagcaaatatatagagtgcttacatgtaccaggtacttttctaagcactttatatgtatgaactaatttaatcctcataataaccctaggaggtaggtattatcatcaaccatacatacagaagagaaaatggaagcagaacttgaggaagtaatttgcccaaggacctacaggttgcatgtggcagaggtggaattcagtcccagatcatcaggccccagaacctggcttcataaacacctgcccttgaaacccactatggagccccaggagtacccatccatggttttgaccaacattacctcctctgtcatttcaagaactctataggcattatctttaggtttaatatatgaggaaacagaaacttaaagaaattatggtaacttgccaaaaatcacaagctccgtagatacaagtcaaacacaactctctctggctctggagtctacattcttatccactgtgcagtgcactgtactgacagaaggggaaaaccctacagtgtgtgatgcacttcctatgtcacagagtatgaagaatgtcacaaggtcacggaatttcagagctgaaagggatcatctagtccaacccattcatttcatgggtagagaactgaaacccagagaaaatagaaatgccaccacctcggtgccagatctcctagatgcccacctacaggtcagtcctctctatagtatcttctccccttttccctttaggttgatttttcatttaaaaattatttgatataatataaattgttatagctcacaattgtgaggaaattataaatatttgcctttatgattttagaatgatgaaaacctttgttattctgcagactttctccaaagctttatttcaaaaagcatcattgttctttttcatcttagaaaacataaaacctacttgcttgtcttcaggaaccctacgaagataaaaattatcacaatttatacccaacatacctaaagaaccctgtccattgtgccctcattggttgtcctcttaacttggacaaatgtaatcacgtctttgatgtatttccagcttcacggtggttttggatatacacttctgtaaaatgatcaagatttttgttggaattcacgagtgtttgttaaagttttattaaaagcgatcctagaaaatataactagagcttactataatatgttctgcaggtgggaaaaatgttacagctccatgaacataaagcaatcattaattagcagcaaagacacgccattttcaatcttatcttttcatgattttaaaaaaaccaacacttttcccttatattttccaggtaaggcatcttaccagttcttatgcactgcaatggccactaggtaatattctttaagcaatactgttatacatattattatattacagcaatcctaaacgagataggaaagacatcatctttcattttctacatggagaaattaaggctcagagaagttaggtgaaaagactaaagtcaaaaatgctaatgggtgtaagaacctgactcaaattcagatctgtcaaatgcatctggtgtctgtccttaatactctattaagttgcctctcttcatttaataaaattctctaccattcaaaattaaagttgtatatctataatgtttgctgtttatttcagtgagtagttatttcagtttttaatagatatgttttcctttattaggatttgttaaaactaaaaaaattaataataacttcaaacaatcattgttatcatttccaataagcaaagcagacaatttaaagagacagaattctcagacatgcaatgctatttcaaagtccattcacgtgctgtgcaaaaagtcacattaaaacactttatactgaactataccatgacctcggcaaacacagtactcctaaaagcacagttatacttgttgatggctatgagtacagattacttccttttcttgatacaaaagtattaaaagtattaataccatacagttaaatctgaggaataattaatttgaaggaaggtaataggcaggtaaagcagctcagtataatcaaaattttcctttaaagaggttgacagttactctgatgtaatatcctggaagtttttttccaaatgtgcacttctgatttgcatgaattttaaagtcattactggtgaatacagaaaagatacaggcccactctcacaaggatgtagattgatctctgatatctagccttcccagtgtgccatttggggtgtgaaaaggtaccccagagccccaaggtctaaaaacccactaaatcagggtttcccaggactgctgttttataaacactccagagaatttgtctctaaaaacaagtgatgaaggacagagacaaaagggggagtgtaaaaaataaccttttttccccttaaagcaaagaatcaacattagtttgtattttggttcattgtagaagtcgatcactattgtgcactaatcatttcactagaaaaagtatttcttttcctaccattcttcaccatgcatgctttagtgcttcacaggtgtacaagtgattttcttaaatttataaccacagtagacttacatagatcccttataaaattgatgcagcagtggtaataggtttacacaaaaattgtaatttatgtcattctgttttgttgaagggaatcttggcttctatttacagctttaattaactactgtatacttcctaattgtataacctgtgagattatggactatataacttaagaaatatctttatctgggaatcccaggtggtgcctgtttgtaacatatgcattcttgaaatatattcttctagacaaaattagtttttagattaaaatattggagaagatactgttcctatgatctcttttattttgtacttcaattccaaaatttataatgtatttgccaaagactttctttagtagctaatggaaaaaaattctaaagaagagatggtggtaaggctgtaattttttaaaagaatgactattctttcattgagatgatatatgtcctatataaaaacttcaagtaataaagagaagtttcagaaagtttcactttaagtcatccaaattccatttatcagaaaaaaaacagccatctctaccaccaagtaaacatcattccaaacatagctaaatgtttaccaaggtagaaaaatggtcagagagatgtatacatacataagccttaattttgaaaaaaatgaaatcaaattatatatgcattttaatatttaaatgttatattttcttttcctttaatttgactaaagaaaatttgaactaaaaactgaaattcaggtaaacgtttcttaaacccaaaacatgttttcttttctacaagggcactccaaagttgaggtaaaaaatggaaaaactttaggaggttagaatcatctgtctatttcaacattaggtagtagctattaaccccatgctatgtagttagggaaattaactgatacctcttccaatattaccttgtcacatattaatcattttcattaacatgctttcattatcatagtttataccatttatatgctattctctaatttctaaagctgttattttttatccatagatagatttgatgctaaccatcttaaatcagagttcctccattcttgagctactgatgttgactcatcatgtatgtgcatgcacatgagtttaaagaagagctccagggttctatattgtctaagttttgtttcagaatgtctttctcttgatactatatttgactgaaaataaaacttgagtcatacttcccctccttcagaattgtgtagtaattgcttctctgggttctcatattacgtggaaattgaaagccaacctttattctccttacatgtagctggtatcttttccataaatgttcatctggttgaatatttatccttggagttcaggaaacagtttaaagtatctctcagtattcattgttctatctaaaattgtcctagaacagagtatgaacttcaatttgaagattcaaatctttgtaacaattttcttctttttattttttatttttattgattcatttttttctgttccctattcttaggatcaccaattacgtacatgttgtctctcttttccctgtcttccgtatctttcttcattataaaaacttcacactgttcatacacatttcattttgtcagatttttttccaacctagtatctatgcttgtgactttgttttcaatcaagtttattctatttgtgttgcttccagtgtctattttatttctgtcatttttttcatttccattttcattttttactgaactcttgttctgttttcactgcttttattgctgtatactctcttctttgaattcatctgtctcctttctgaaccctatttttagaatacgtatttgttgtgatatacacttgtgtcatttatttgcttgttttcctctccatgtgtgaaacagaaaatggtagttttatgcatgagtttatccactgttccctttctgatcgctactcctctttgaatgagatagcaactgaccaagtagtacaatggggaggggaagaggaaggggatagctggaaatgtactgaggaagttggcagccactatttcagcttacgaactcaaacatcttctttccaaatattttattttcttaacattgaaagtagttcttccctcgtttctttttgtttgtttgttttatttaaggagtttgcatggatcacagcaagtttccctacagcagtgtaccacctacttcttccaccttctttgacagactgcctgggctgaaagacaaagtggtagagaatagaacgaggttgttggcagaaagtccctctgaggcttcccttccctaccattctagagtctcaggcgggatttctacgtggttattctctacttttcttatgtatcacgcagaaactaagctctctttaatcaaaaactaccaaatatttttgggggaaaggcacctattgataatgtctgagtcaacatctcttagtgggtttgattatctatttcaatatttaatatatggacttcgtaatttgtatcattgcagttgtgaggcttccttgctttcttggagatgacaatattttccctcttttttgacttctttgataattttagtagactttgagaaagtaagaaaaacacctctataacaatatctaaaactggaatgatacgaatattttatatcctatcaaaataagttttaccatcaaaatgtctggttcaaaataggggatttctaattagttcacataaattgtatctactgaataccttctatatatgagaagaacctagacacttggctaggtgcaggtgtctgtacaaaaattaatgagccaagatctggaatctcatggagctcacagatttatagctaatcattgtataataaaatagatgtaacaataactgagcaaacaatatattcatagtatgaaaatatgggatttaatattttgtgatttccaaagtgttttcaggtccatttaactaatattcattgagggctatgttagatctaaaaacattactgaaattgccaacttcaaataaactaggccaaggttaggttagttcccaagaacacagtgaggttaggttagttaccaagaacacactgacatagagaaaggctgtttctgattagaatctaggattctttctaccacatcctgttgctctggaaagaagaacagagttgattatgtggaataaaaagaaatctactctgtgagccacgattagtcctccacataccatgctggcatccacaatctatcttttgtgtaccacactgggaaccacaatccatcctctatggttcggcctttaagaaatatactgtgattcaccctcttgcagtaacagaaactcatatggctctacctacaacaccagccatagttctaatgtttggaagtggaggtatttgaaaatatttctttcttacaggacagttagtaggttaatcaaaaaagttgacaaaatgtgatgtcacaaaaatcatctgtgtgtgtgtgtgtgtgtgtgtgtgtgcgcgcgtacaattttatgtgtacaattttattttgagatggagtctcactctgtcacccaggctggaatatagtggcccaatctcggctcactgcaacctccgcctccagggttcaagcgattctcctgcctcagcctcccaagtagccgggactacaggggtgtgccaccacgcccagctaatttttgtattttttaagttgagatggggtttcaccatgttggcaaggctggtctcaaactcctgacctcaagtgatctgcccaccttggcctcccaatgtgctgggattacaggtgtgagccaccatgcctggcctgtggatatatattaaacatatattttaacttaaaatatataaatgttaattcacttttcaagtgtttacagtagggccaagactttgtattttggtagtgattcactcactataaatatgtacttttctgtattttccactttcatttatttttacttaaaatgagagcataaaggcatatgaggccaactacagcaaatgtctatgttttatgaggtagtttactcttcgctttcacccatttctgatttgattcctgattcctgattttcttcacccaactttttaaaggcaacaccccttaagtcttatcagcatattcaaattggttataaatgtccaaaaccacatttgtattttgcatttctagtatgttacatgatatttgattaaattacataaaaaatctagtacaactgttataaacatgtttgggaacaaatacagatgacctttaaataaggtttcaattcaactggtgagagcagtaatagacagacctgctagtgttgttacctagtgattaagtctgtgggctctggagccagaatgcctgggtgtgaatcctgatccattacctactagcctttttaaccgtggacaagccacttaacctctctgtgcctcagtttcctcatatgcaaaatgagaatgacattaattaaggttttgttgtgaagattaaaggagttaatttgagcaacgcacttaaaacagttcatggaaggtgttaagtgttgtgtataaatattagatattattactacccaggcattcagtgtataagagacgccagtcaatgtgttttgcagatgaaatggaaaacactagctaatctggcaagtgggttaaagggaaactattaagacaaactctgattttcagtatcagtttgttaactagtgacccttattagatcataagtatcttgagagcaggaattagatcttctgttccattcactattacatatctaatgaatacagtgcctgcacttactaaatattttctgagttaattaatgaatcaagttcaaatatggtaggatgataaggtttttacaacaggatatcaatactacctcataaatatgggttacttcacatttgaaaccattcttgccacttttctttttttaattttattttattattattttgttttgagacgtagtctcgctctgttgcccaggctggagtgtaatggcgttatcttggctcaccacaacctctgccttccgggtccaagcgcttctcctgcctcaccctcccaagtagctgggattacaggcatgtgccaccacgccaggctaattttgtgtttttagtagagacagggtttctccacattggtcaagctggtcacaaactcccgacctcaggtgatccccctgcctcggcctcccaaagtgctaggattacaggcatgagccaccgtacctggtttcttgcctcttttctaattgattcttgcaagaactttatcgtatataaaattatgtacactttataaataagaaatatggagtacaaagaggttgagtaatttgttccaggttacacagtgtgagtcattgatatagctggggctcaaagtcaggactcctggaggtctccctatgtaatgtcatcccttccatataaatagtcttaaaataacctcagttaatcctttgtctccatgaataccatctaccctgtttgtcctatttgacttttgatgctccttactcactttaagttcaaattctaagcgtccgtttatgaacaaatctgttcctcttccgttcttgcctaattttctccattgctgtaattctaccataaaaacagccaagcatgagattaaatgcatttatgaaataagaacgtcacttgtttaatttgctttaaatacctcacctgtgatgcatttaacaacataattgtgttaataccaatatcaactgctttccctcactgtgtcaagaagtacagtagtttagattctaccaaggtcaccttctcttgcagcacagtcccaaatcgccttacaataaaaaacatgttgtcaaaatcaatgaatggacagaattatagtattttttataatcatagcttaatgaaattaaatgggtgagccacctcaatctaagccaatctttaaaatatcatcctaacaaatgaagcaaataagtaaagaactattatgtgggaggggaagcaaggggttgacaagcgctcaaatatacagcctcatgttaaattatattattaagagcacaagggcttctttatattcataaccattcttaataatatgtcccttctgagcttttattatcttctcttatgaatggatggcagcagggatattgtaacttatctcaattgtaagttaagctatgtaggattcatctctgttcacttacagagtctaacaatttatcccctctataagtttcacaatagtcttaagtttattgaactcaaaccattcaacaaatatttactaaattttgttatgtcttatccactgtattgggcactgtagagaatcaaagattgcttaaggacagccccttacttcaacgaacttaaaatggaatggaaaattcagatttggacatcaaaagttatttaaggggagaataagcactaaaacctgggttttaaaaaggcataatgaaaatacaaactagattaattctaatggaatgaccatgtaagtttcagaaaggtgtagtatttgatggtttcctaattagtagggttggaacagaggggcttcagatgaagagatgagagtgactaatgcatggaagaggaaaataaggggcctcaggaataagagtatgacattgtggctaacacttacactacccggaagatagtgtgagaaaaggctagaaggctagttaaaccttgactatggaaagtctgagataccaactgaagagtttgcccttacttgacagttaacaggtattaaaacttctctttgtttcatttttgcagtgggttgattatatacattttgtaactattactctgacaggaggagataaaatgtgacggaagaggaaggccagtcaggctattgaaagtaatttaggcaaaagtatcaagatcagaaaagaagttcaattatccaacacaatactgggaaaaaaaagctcaactttgtcaattattaagcaaagatatatacagaatatagtaccatttcacacctttaaaattagccaaaaatttaaacaataattgtgaggttaaaatgtaagaagcacttgtatacaatcagtgaataaatcagtaaataatacttttggaaagaaatttgatattttaaaagtcatatgaaacatatatattttactgaaaatataaaattttaaataccgttcatacaaagagtcactgtcatgttatttgtgacagtaaaaacattaaaaaatcctagatgtctaacaaaaattacaataaaaaatttgatgggttgctatgtagctatcaaaattataatcatgaaagttatgtagtgatatgagaaacatgtaaaaatggaataaaattgtatctatactattattgcaactaaaatgtaaatatatattccgaaaaaaatggcaaaagtacatataaaattaaaagttgagatactaaaaaatttcctcttaagatttctggacttcttaaaatgtgcacaataagtaatttaaagcattaatgtgatgctgaattaggacaatggcaatccaaatgaaaggaagtactataaagggaaacatggtagaaataaacaggagtgaagtactaggagtttgaagggatgaatgaaaagaaggatgcagacttagaggctgagagcctggtagaatagtcagagaattaaaagtaaactaaaaaggtttattcatgccagttaaagcaaacaagttctgctctaattgttaagtcgcaatagacctttcctacgcatttggaagtacgaagtgtatttctgaagaaatatcagtgctaagacaggaacttggaccttccctgaagtagcttgtatttgaagccaaaggagtgggaaaaaaatatatatcaaatttaaggatgtagaacaagaagagaagacaactttggaaagaacatggagcaacacttccaatataaaagataggaaattcaaaaaagctacagaagcactctggaaatgaatagtcagtgttagagatccatgttagcatactgccatggcaactgagaaaaagctttttgtacacacatgcctctgtgtgtgtgtgtgtctgtgtgtgtgtgttctatgaaggaacaagttatccacatattatagagaagtagaaaaggaaaattgggaaaacagatcatagaagttggctactccaagatgaccctagaaaagtagttttcacagactaataaaaataaaattttcagagatgacaaaggaaatggcaggaaggtcatgaattttaactatgccttcaaaaaagtgaatttagtaaggttgcagtgtacaaagtcaatatacaaaggtaagtatactattttttaccaaccacaaatgatgaaaaattttaaatatacactgaaggccgggcacggtggttcatgcctttaatcccagcattttgggaggccgaggcgggcagatcatgaggtcaggagatcgagaccatcctgactaacacagtgaaaccctgtctctgctaaaaatacaaaaaaattagccgggcgtggtggtgcacgcctataatcccagctactcaggaggctgaggcaggagaatagcttgaacccgggtggcggaggttgcagtgagccgagatcatgccattgcactccagcctgggcaagagagtaagactgtgtctcaaaaaataaataaataaataaataaactgaaaacaaaattttctgagtgaaatttaaaaagactgaaataaatggagaggtataatatggtcagtgattggcatactcaatattttctaatgtcacttttccccagttgagctatgtatctaattcaatgccaatcaaaatccaggtagactttttgtagaaattgacaagtagattctaatatttatgtggaaatacaaagaaccagaacagtcaaataaaggaaaagatggtatggtaaacttaagatagtatcaagatcaattctctaggtaatctacagtgaataggccacagaagatagagacccagggaatgtgaaactgctgaaaaggttctatgtagagtagaataagacattcctccatgaaaagtttcctcatggcttttcatgcttcctgaagtcaagaacttcaggaaagaagcatcaaacttcagcaataattccaacccctgacaatccaccaggcttatccatggatcttctatagagaacgatgactaaaatctacccctagagctgattatttaatagaatagctctaacttaagggatctatgataatacatgattcttccacttctcatacccaagcaaagtctaatgctgtcagacaaggtgatgatcctcagcttggaaagacctaaagtgggaatgctaattcctgtctctatactgtcattagaatctatggagaaaaattgagtcaatatgtatcgatctatttcagaactactaatcttcttacaaagacatcaaggaaaaattacatagaatataaattgctgaaacatgaattggattttacttaacataatatacaagaaagcatgtaagactgcaaggttaggatacaggagttttacaattttgctacagattatgtaacttcaggtagaatgacactcaatacttggatggtgttactatgaaattcatgggtaagaagttgggctagataatttctaggattattttgggttattactcaatttctaatcctcagagtctatattaatttcctcttgctgctataacatattaccacaaatttagtggtttaaaacaacacaagtttattatcttccggaggacagaagtccaaaatcagcctcactgagctaaagtcaagtcagcaggactgtgttccctccagaggtctaggggaaaatatgtttccttgcctctctagcttctaaagactactacactccttggctcctggatccttcctccatcttcaaagccagcaatgtggcatcttcaaatttttctcctctctagctgcttcagtcatctcattgtgttctcgtagagtctgactttactgcttctgtctttatattttttctctcttaccatgaccttcctgcctccctcttacaaagacctttgcaggtacatcagtgagcccacctggataatccagtatcatttccctatctcaaaatccttaattgttctgcaaaatctcttttgctgtgaaaggtaacatagttgcaggttctggtgattaggaagtaaacatctttggtgggtggagggcattatttggcctaccataagaccacgttaatatatgcttcaaagtcattatgttttggagttatgctataaaatcattttcctaactttgaaagaaacaacaaaatgagccatatatgcaaatgggtgtaaccagcaaaagttaccttagaaaaatagataattggttcattgatcttgttaatgctcagatattggtaaattatttatttggaaggaccttcagagcctactaaacattctttggcatgtcattgatgttgctttaaatattttaacttgctcaaaagttatttataaccaatattaatgaattttaaaagaaaccacaagaggccgggtggggtgactcacgcctgtaaatcctagcactttagggggccaaggcgggcggatcacctgaggtccggagtttgagaccagcctgaccaacaagaagacaccctgtctctactaaaaatacaaaattagccaggtgtggtggcgcatgcctgtaatctcagctactcgggaggctgaggcaggagaatcacttgaacccaggagcggaggttgcggtgagccgagatcatgccattgcacactccagcctgagcaacaagagcaaaactctgtcaaaaacaaaaaaaaaaaagaaagaaaggaaggaaggaaggaaggaaagaaagaaaagaaaccacaagaaatatttttcagtatcacccaccaattggcactgaaagtaattaccaaagactcattcagttaactaaattctggtatatttgcatttttaagttgtttgattagctcataagcctattttgtaagcccatgcaaaaaaaaaaactcctctccccaaactaaaaacatggttttgtaaaggccacatatccaactttttacctcccctatataattttttgatatacttgttctctcctaagtacaatgcttgggaaaataagatcatagattaccaatcactcagaaattccagacttcctatataataataaaagcaagtttattaaaagggtgaaaatgtattttgcatcttgttatttgcaatgttactgagaatagctcggtttctgacttttttctttaacccctggaggaagaatatttttaaaatctatatagcaagttgaaatcctctctaaagtactatataagtactatatcattacacaacaacaacaagtattgttcttagttacattttgaaaatccagacaagttataatgcccattaacatatgttcttaatttttactcaaatactgatgatcgctataaagacacatgcacacgtatgattattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaaggacaaaaaaccaaacaccgcatgttctcattcatagatgggaattgaacaatgagaacacatggacacaggaaggggaacatcacactctggggactgttgtggggtgaggggaggggggagggatagcattaggagatatacctaatgctaaatgacgagttaatgggtgcagcacaccagcatggcacatgtatacatatgtaactaacttgcacattgtgcacatgtaccctaaaacttaaagtataataataattaagaaaaaaaagagagaaaaaaatacttatgaccatctggcaatccagattcaagtagagttttaagaagatgaattaatatttttggaacattttgtaaatatacattttgtaaatatttttatatttgtaaatataaaaatagaactaatgaattgtattaaatactatttaaaataaaaacaaaataatataacaaaacaaaagaaataaagcagtgttatataagtaatatggaaaagttttaaatcttcataaagctaagagggaagacattcaagaggaacatgccttcaaatagctccttatatattagtcaaaattatctctcaagaaagaacagtcttctgaacattcatattgaaggaaaaggagcttaaaccctgggaggaaaccaatttcttcataaagcatctctttcagtttgagcaaccagtgacgaaaaagtatattaacgttcatttaaaacctcttctgtctggttcttagttgttcaaagagttgattgacataaggagagatttatgaaaaatgaaacaaactcttctcatgtgttaattaaaagagttcagaaacctaaaatctacaaagcttattttcctcatatatctccttaactctgagaggttgtaatttaagatcacattaaaatagaaaccatttagaagagggatcatgccttctttattctgtataagacacagttaattctgggttctcagaaaataaatgatgataaaacatctccttttaccaattcacaaataatttcaaaggactcagccaaatctgaaaactctctgagagcgtagatttttgccttctacttcttttatatcccttatagcatctctagaattctgctgatagagtgagtgcccaataaggtgagaagacagaagagggaaaggagcgtaggaagtaaaggaagaaaacaaaaggaggagagatgaggaaaggaaggatgagaggaggaaaaggaagatagagctgaatgagtcacctagatctttttaattcccctcgtggaactcactgaaagttttacatctgacattcaactgacattcttctaaaattggtattcctggattactttaatgactcagaaaatattaaatacctatatttctgtcaatgataatgacttgccttttttttctttcatgacttttttttttttttttgatacacagtctcgctctgtcacccaggctggagtgcagtggtgtgatctcggctcactgcaacctctgcttcctgggttcaagtgattctcctgcctcagccttccgagtagctgagactaaacatgtgcgccaccatgcccagctaacttttttgtatttttagtagagacagggtttcaccatgttggccaggatggtctcaatctcttgaccttgtcatccactggcctcccaaagtgctgggattacaggcatgagccaccgtgcccggctgacattttcatataattgtccataggtatttctgagattgcctaggacatataatatgtccaccagagtacctacaaagagtatattcgttttttccttttaaaactttaaaatttacactgatagatatttgctgtttgcttctgaatgataagctcttaatgtcataatgatgatgatatcactttatatttgtatagtacttttttgtttataaaatctccatctgttttctcacttgaccctcataacaaccctgtgaagcaagtaaggtagctggtattaactgtatttcatatgtgaaaaagaccagctgaagttcagagggaactatccaaggtcacactgctatattcgtttattcttctgatcctgagacattttgcttttctctactgatgagtgtatgctgcactgcattggacaactttatatggagcccaaccttttcttttcactggagtttcccatccactcttatttcttcagttttgtggtttgtcattgtttgtttgttgttgttgttattttgttttgttatttaatgtaatggcacaggcagataaattaaattttgtctttatggcaacaattttatggattgactcagaagctacagaatagatttggagagtacctatcatccacagcttgcatgacttccagtatttaacatttctcaaccaaaaaatttagggtttgacaatcagtctttattaaaaaaaaaaatctagaaggtagtacttgagagtggatggcatctggcaaactaggaagtaaagactttaggcaaatagtcaatgaaatcgagcagacattttgaaaatagaatgtagttatgtcaaacagcatgtgcaatgagaattttccaggccaagaaggaagtcagagataactgatacaacaagctagttctacttaaaaaaaaaaaaaaaaagttcttggagtttattttcccttaatatttagcaaactatttagaacatttaaaatctaaaacgattaaggtcttctaggaaaaatggaagcaggctagtgaagtcattttagcatttttgaggtttcctcccaagcattctacaagtaattacattaggaagataggaaatccctgagtagactattagtagtttagtattaaaatatcaaaattaatgagtcattttaacattttggtgcaagcataaggcaaaactcaactttttattgtaccacatacttagaaattagagtgcctcaaaaatcaacagcaatcatatcgcaactccccactaagtgttttctctgtgctttccattaataacatcagactagcccaggagtatatgtggatgtaagagcacactacggtgagttcaaaaggtgtgctttgctgatctttctttatgtctctctactgttcagcataatcacctcttttattagctgatgacttctatccaggccattactccataagctaaatattagcagctatttgaaaaggttcactaatgtaccaaatattcttaaataaaacatgaatttacagttgaaataagaagtttcaactaaacaattaaaacaaatcccaaatccatttggaggatattaagcaaatttgtaagcaaatagggtcatggatattttggagctggttcagagcaggttgattgataaatggggaagacctataaagagaggttaaagcagttggcatttgggcatggttgagggttggtttagttactgtcttaggaaaagcatgataaccggtgggtactcatctacttgagtcaagtatacacaaacacaaacattatttaagctatagcacttaagattttgaatgtcacaagtgagttttaacattgtattatttaaaacttacgtaggttacaaaagagaggtttgggatggctttttctcattgcctttaaaaataaattttaattttcccaaaagacttaagtgtggctctactaaagcgtaaaacaaaagatatttttacaaattaacttttaactctgtgattctatatcaaaaaccaatcaatacctgtgatgtccaatagggtagccactaacctcatgtacctatttaactttaattaaaattaaaagcacggttcctcaatgacactaaaaaccattctaaatagacacgtgtggctactggacactgcactggacaatccagatatagaacagccccatggctggccaaagttctgtcagacaacactgacctatccaaacatattccaaatccttcataaatgcattaagatatttgtgccctgtatttcaaacactttgataggtaaataaaattaatttttttctaaaaaacaatcttgtaataatcatatagaaggtgtattttaatcatcaaaataatctgttttcaaagtttagctaaattaataacaaataagcttgtgctaaagcaccagttggatggtttacaagggaagtcagacattcatttattgcatttttacacttagcagcttcactttaaagcattctgctctacataatggtgctctgttaaacaatgtttaaagttaagaaacatttgaagtcgagttctaaagcaatctgcatatgctatcatttaatttataaacttttgaagcacttttaaaaaccctcttaattataaaattaatgaaatatttaaatagctcaccagttaaaaatttaggccctgttgtgaattaaggaattaatcttgaactatatttatacattatgtgtatataatatattcacacccacacaaaaaatatataaatacataaattaatactgaagtgccccaaaggagtgattttacatattgtatataataattttatatatttttatgaagataaatatctgattttgcatattttcatgaagatattatgtagatcaatatatttgtttatcaccattattatttctccatagagataatgaagctgaggtagaagagataatttaatccagaatatcagaaaagtaccggtcagatgcggtggctcacgcctgtgatcccagcactttgggaggccgaggtgggcagatcacgaggtcaggagtttgagatcatccttaccaacatggtgaaaccccgtctctactaaaaatacaaaaattagccaggtgtggtggcgggagtctgtaatcccagctactcaggtggttgaggaaggagaattgcttgaacccgagaggtggaggttgcagtgagccgagattgcatcgctgcactccagcctgggcaacaagagcgaaactccgtctcaaaaaaataaataaataaataaataacttagctgtgtcacacacagcctctgaacacacattttaccccgtcatacttgacttctgttttcacatgtttgtaaagagtttaaactagatgacttcaaaagtaacctttacttaataaagttgtattattccaggtataaataaaaccctctgatttatataaattgatatatatgtctatatataacaatacatttgtctaggtcctttcctagtaaaactgttcaacatcaaatgaggtagaaattcacaggttttaaatttttcagtaacagagaagggaaaaaatgcaagaagtcaagtggtttgcagatgatagaaaaaatcagtgtcagatctaagaatatcattcttcgtcttcacttctggctacattatccctttctactatacattgtgcttatcactaatgtattgaattaacatgagctcacttcaaagattttcaagaaaatttatcattttcctgataattaaaaaggaatactgccaagtaatgtcactaaaagactgacagggactacttaggacctttaagaggacataatgtaacagcacttttgcagaagtcaggttattagaacttaagtgttggaggtttgaaatacgcccatcaacctggtaacaaaactgtcagaattaacaaattgaaatacgcactttgagtagactaggaccttagtttccgctcaaagataatgtaattcttgtgttaaagatctaagaaatgagtgagaattactctgttcttagagttctgcaatgtcacaagatcataaaatcctgaatcaagaaggacagatcagaggtcattttgagcagcctcttttattgggccacaaaacatgcttatccccatgcaataatggcattctaattccagtctttatcaatagtaacaataactttagcaattactttttaatctcagaattctagaaatctgagttctaacaaaaacacggtgtatataaaatggtttatggccatgcataatttgtctgccttcttttccagtaaaatgaggtaggtcatgtacatttcatattttagctcatgaaatcttcaccattttcccacaaggtttgtttccactttatatgtgagaacctgaggcctagaaaaaatatacaacttgcccatggacacacaactagcaactggttatcagccaagatttaagtcctctactttgactccagaactgacattttttatattgtgcttcattgctttttttttgtttgtttccagaacaagggttacctatgcagaggtaactgacatatgaaaactatccttagaaagaaatcaagtaaagtaaatttgcctactttcctcaatagcccatttcgcctccaataaaatcatatttaacgggttgatttccaaagtatgagtttgttttacaaaatttaagaggaggaaaaaaagaatatgggtgggatttgtggaggtcctgctatagttaatgagaagatatcacaaatcaggtaaaaatactctctacagatttcttttatgtttgcctcacatactgccaggtattaagcatcagacagatgttattgatgtaatttctacagttacaatttttcacttgaaattcaaaggtagttaacagaacattattcaaattgaatctgtatcatgtttaaggcttctagcttcattatataatatcctgtgtaaaagaagccaaataataaaatgtctttgatgtcaacaaaagcaattttcctttttttatgtgttctcagttcaattagctcccctatcagaccacactgaatccttggctctcagttactaacatacaagcttttcagctgtatattaaaacaactaaggttttggtactgcataatgacattttctatttaattttcagcacaccatggaatctgaagtgattcagaatggctggcttttgaaattcctttgaactaaataaagcaccttcatttttacttgaattattttacagtacttttaccaatgcctaaaggaacaaagataacagctatttttttccaggaggattttggaaactcgaaattcttaaaagaactattttaacaaaaataaattgaaggaaaccgactgattttaattttagagatcattgctttcaaatatatgatcttcaagtcctcttgaattttgagctattttgaaatcaagttctatttgtataaggctttctctctgaggcaaagtgttatgtgagggtgctttccagcattcaaaagcattatatctcaggtcttaaccatatttccacatgtgcacatcttccatcaaactgtggctcatagcacagttatgcaacacaaatctcgatgcttctctcccatcaatttttgaggaaatttttgaagagttccccaaatcagattattatctatgtatcaatacttggtcagaaaaaattcacctgaaaaccattactgtatactgtaccaatacacgatgtaaataaaagttgagtgcagtagacatagttcacttctactacttataacacacatagtgcctaatatgtgccgagcactgttctaactacatattgtaactcatttaatcctcacaacaaccctatgaagttagtactattattttccccattttaaagagaagaatactgaggtacagacagatcctaaatggtggaactcagattcaaacccaagtagcccacttctagaatctgcataagtaacttttactgtatagtgtttctttttgttttttttggacgaagtctcactctgtcgcccaggctggagtgcagtggtgcgatctcagctcaccgcaacctctgcctcccgggttcaagcaattctgcctcactcagcctccctaatagctgggattacaggcttgcgctaccacacctagctaatttttgtatttttaatagagaccaggtttccccatgttggccaggctggtctcaaatgccttacctcaagagatccgcctgcctcggccttccaacgtgctgagactacaggcgtgagccaccgcgcccggcctatactgcttcttaaaaggaaaaataagctgacacattgttagaactgcagccaaaccagtgcttttaattacctaactagtgccaatggactagtttcctatcctttaccatcctgtactatcctttgcctggttgccagggcaaccgggatcactttctttaaccacactggagcttattctgtgtaatcatttgccaagcaatcatttgccaagcaatcatttattcagtcattcaacaagcacaaatcaagtgccttttatgtgcctcacacttgtaagtgatgaggatacaatgcccaataaaatgttctggttgccctcaagaagctgatattccttcttgcaatacttctatgttggtttatgatctatcacatcttctagtgtccagtgcctatactctctagtgtcttaggctctccctttctggttcctgggtattgtcatcatttcaatctcctaccctccattaacacatttatattatcctttccactccttcaatgccatcatccaaattcaggtctttactaataacctacaaataaattacaagaatggccgtgtgttctgttctccttacacctaatctttctcaaacgaacttatttaaccacatcaccaccctcctactcagatgcaaaaactgactctctagtggctgtataataagtaaatctctttcatgtaatattaaatactgtttacaatttgacccccaacctaccatatcagtcttgcctcctaccatttgcttcagatgcactccagtctaataaaatatatctatttgcagttccctgcttaccatttgatcatgttgacatatctcttggcaatgctatttcttctggccttcttactgcctgaaatatgcccacctatgtctatactaggaactcttggaaggccccgttcagaaatcacttatttcaagaagcccttattgaggtcaccagttagaagtgctcactgtattttatgaatactgatagctccgcatagcccaatctaatattcacctgtattgaattatctgtgcatattacctctgctagactgtcctattccttgctgataccaagtacaagttccttacccatatgaatatatagatatgtatagcatagtgctctgcatatagagtatctatatatatagtcaaattaagtaaaactatgatttaaaaatatgctgcaagtcactagatttcttaagaattgcatataacatcatcatatttactgttgtcaaaatataatgttgagaatgattcagaagggaccaaaactgaagctaaggagtttggaatgactttatatttatatgcgttatttaaagttaagttcctttgaagttgttgctcttgtagatgttggtatttttttttaattttgaagttggggatcagggagaaagtaaagaatataggagaaagtttacttgttttttaatgtgaatcagtaaattctaactcggagaactttttgacacacaattccaaaaaccctatcagaagctttgacaagagaagcagaaatataaggaaaatttaaaaagcccaagaaatgctatcagttcacctccctcagtactcaaaattcaatctttcaatcaaattaggcaatagacctgaaccacatcagctgagtacatcacagaaatgctttcactgtattgagctttaatgttattcttatagcttttatcaacatttgctttaaaaaaaaatccatagctgaagcatgcgtctgcattttacaaagaaactgtccagtacattattctatattccctatttagtagccaacattagaattttaattcaagttatgctttcactttctcctttctgaaaactagaactagacaacttttcttgcttttcttttttgacaaaaacaatgctttaataaaacatggatacagaattagagcaattatgttaacagtatggctactgaatttgcatcttctaacctctttaggcatgaccttatttctattagagatattagaccttagtagagatagtctcaattataattgttttacataatttggggatttattttattttattttatcttattttgagacagagtatctctctattactcaggctggagtacagtggcatgaccatggctcactgcaacctcaacctcctgggctcaagagatcctccaccacacccagctttttttttttgagacagagttttgctcttgttgcccaggctggagtgcagtggcgcgatctcggctcactgcaatctctcccttcagtttcaagcaattctcctgcctcagactcccaagtagcgacacctgtaaccccagcactttggaaggctgaggcgggcaaatcatgaggtcaggagtttgagatcagcctggccaacatggtgaaaccccgtctctactaaaaatacaaaacttagccgggcgtggtggcagctttttaaaaaaatttttggtagagacaaggtctccatgttgcccaggctagtatcaaaatcttaagctcaagtgatcatttcaccctggactcccaaagtactgggagccactgcacctggccaggggttttatttttaagagtatactttttaaaggataaatatcgaggctgtgcccattcatttgtttatttatgcaataaatattatcttttttcaattctagagatacaacagtgagcagagacaaaagtttcttccctcaaaacacatataattctaactctgggaaatgaatattaaagtaggataaaagcaaaatatataaaacattggataaaaattgtgaaaaaaaataataatgcataaaagaggaaggaaagggtagttgttttaaataggaggaaatgatacttggttgacaacccaaagggagtgactcattcatctatttgagatgcaggcgatctagtcattaagtacagagaccttgggtgttccggggctacctggagaccaaatggttggagtgaagtgagcaaggaagagaggcatttgactgggtgaggatcttggagtttattataaggactttacatttgactcattaaacaagtagagagatgttcacacatctcaactaatagtaataggtaatttttaaatgatgtttacttgtaagtaatgtgtcagtaagcatcagcaaaaaatgttactttagagatatttaatcatttagtttaatgccatcctttctcttctttcatgtactcagcaaaatcatattcagcagttactatgtggcaacactatgtggcaacaatggaaatctaaaaaaaaaaaagaaaaaagaaaaaaaaaacataattccaaacctcaaagaaatgtctctcaagtggcagagataagtattaattattaaaatttcttttctttagcttttaggtaagggaaactatataagatgtttaggtagaggagtgatcatcatatctgcatttcaggtagattcacatgtagaagagatttgaatgaagtatgactggatgcaaggagatgaattagaaagctgtgaaaaatgatgaaaacctgaactaagacactaacagagggtgaggaactaagtagaaagttacaatccatttttagaatggagtattgacaggactttatgactaaataggtgtaggtggtgtgagaggaggaggaatcaagaataactcccaatttttaacttgaacaaatacatggatggtagttacagtcagtgagttcagcttaggacaatttgagatgtattggtaaattatgattagctgacagttgatattatggaaacccagagaggttgatagatttaaaagaaggtccaggacagaaacccaggaataccaacattcaaacaggaggcagagaaataattgttcattaaggggattaacatgaataaacagaaaaaaattcatgtaagccataggagacgagagattttacatctaataatattgttgactgtgtccacctgtagtggcaaacttgatgtgattatttatttcgatttaatagtactgtttatatgagtattgtagagcaagcatttcagagcaagttattatatttataaagattatctgaaattcagttggataatcctcctgaatataaaatatattgtattattttattgttgttgttgattagccattctaaaaaaatctatcctcctaaaataaaaatgcattgtaaaattatttccttcagtccttcaaatgtagtcacttcaatgtgcttttaatattttagtttacttaagtcactatatgtcaattaatatcatttatgaggaaagaaatagcagtgctacaaagaaacaaaaatacgtactataagaagatgaaaatatatgtccattaattagaaaatcctaggctactgtgtgagctcaggaaaaggacaactcatttatgaaaatgaggttgatatatattctgatatcatggaaatttcaatggattataaaatcagtggaagctcaatgctttgaagaatacattaaatgtgcataatagcagctagtatatttttgttatctggtctttcaaccaagtacttgtcaaccaagaattgcttacaaaattttcctatcaattcctaaggtgaaacaattaacagggttaacagtccaaaatcattagtcaggtcattggcagaaccaggagttcaatatgagatattttttaaatgtctctctttatattgtctgatacttaaaatctttaaaagtaaatgcataaaatgaaaacatcaatatgtctttatatattatgttataataatacatacaaatttagtagaaaggaacaaattaactataaaatccagataacttgtagcatatgtaaaaaatagtcttttgagaagattcatgatagatattaatttttcaggcataatcaagaattggaatccaaacagtagaaaattcgtgttagaaaggacttgaggttgctatatcagcagatatgttctcctttatttttacagtttctacctgtcatttgctctataataatacatgaacaaatgcctcacactgagattactatgaaaccataagctatactgttaccatacttaacattataaccaaaattacaacttcacaaactgtaactcgaggaaaattacaggttataccaagtgtagcagatgtatagaactgtagcagctgttagaaatcctgaatattataccttatgaaattatatttccagttaacataaatgctaaaataagttatttattctaagaagttttttctggagacaaacatttccctgtgcagcagaaaaagcctagtattagaaaagcctgctcttacaagtacattcgaatgttcagaaattcaaatgaagcatatgttgtcaattaatccaagtatataataatttttaaattatgcctctatttacctatgggtgatgcataataatttattaggagagttgttgatactttttttgtttaaaaaataattattagataactagctcagcatcatagagaactaatatctagaggttagaggtgaaaattagtaaagggaccagaaaaattaaaaatcatgacagaacaccagcattatgtaaacagttaagtaaatcaggattaagaaccatcccaaaaatgcacctgcaaaatcgaaacaagcaagtagattgtttagatctacttgcttagtccactgcttcagaaatcagcactgctttgtttaaaagataattattgattgctatgttatataataatcttccaagaccgttacagattaatctgaatacctatgacctcaatctgaatttctatgtcttagaagttttggagatagccaacccaccaatctgtcataaagcatattagctgtctgggggttaccagttcctcaggaatgtcaccctgtcctgtcctctccatgtgctgatcatgaggagggttagtgacactccacacccattcatctctctcttttttttggtagtgtaatgagtacagcaatcattctagcagtatttgctatgacaacatcattcagccccaacttatgccaaaaatgtgcatgttaagtgaagggaaacaagctctaatggtgccctttaatgttctgaagacacaggtgttctctgtgaacttgacatttgctcggtctacatgtgatcctaagggttccagataagatgaattactgtgtgaaagtcctcaggcattttctcacagataaatagcatgaaattttgtgatggagagagaacaacctcagtagtaactaggtaaagattgtactggttccccagttgataatgggagccactgcacaaaggtcaaacaatttggatgcaaagtatccaatttgtcatcacaaattggatttgagagtgccatgaaaatgatgagccagcacactgcttctaccccatggtgacatttactctctcttacccactctcccttagttcttatggattcttctgaaaatataagatggaatttttttctagatggattagagaaaatatgtgtctatattttttaaacagtatacaatggtgacattattaagatgatgacactgatggtgatgcaaattaaaacccctgagaatcttcactagatgcagtaataaaaaggttaaccaagatgtcaggaaaaaatgcatcctgaaatatcagcgtaaaagcagaatccattctctgtggtatttttaaaattataccacatgatgttaaattataagcacacatcagttcaacctagcaaactttcattgaacaactatgacatacaccaaagagacaaagataaaaaagaccttgactgacccttcaaggagcttgcaatcctttttaagtggcaaacatttatgccactaataaggtgatataagcattttatacttttttttagatttagaaatattacagtaggagaaaaagcagatctttttacacacacaaagaaaacacttagaattgtactgataataagattagtgttatttggtccatagagatgccaaggtatgtcagttgtctcactgagaactagggaattcagccaaaaatggttcctgatcatgttctgccagagcaaatagtactgaagaaaatcaaacttgtcagaatagattttctgagatgtgatgagctagtgttagaatgtgaaccaactagtgcttgaatgttgaactatgcttccagccttatggagagttaaggctccccaagctgcccaaggggccttcgtgatacctgttttgttactataaataatagaggttacttagtgaatgccaaaagtgatctaaacattcattagtattaactgtatacctatgttgcaaatatcaccagaaaagatattggaaaggtaatcaccatcaattcttatattcctaaagctttcttccagtcctctttttctcctttcatgaaatagttttcagacgcagtttggaaaacaagtatagtaattgactggctcataaaagcaatggaaattaaattccagctgtattgtcattttcaaactcatgtttttggctacctcatacctctaaagcattaaaattggcatgtgtctattaatacattcatcaattctttcattcaactcaataaaattgagttcttaccatgagctaggccttgatgactcatagataaataagataatattctatcctccagttttgcttagaattcagtaaggaaagaatgacaataaagtgctgtagctgatatattgtattcaggttaagataggaaataaggctgtaatgattcattctccccctgtgggattgggatcacattcataaaagcaattgtactggggtatcaaaaagtttgtgaggttgaaacagaaggacacattgggcatatatagtagtttgataaaattgaagtaaccttaaagtacgtgtgaagggataggagacgtgagcagagctgaggctgagagacaaaaaaaggcctatgtggtaaattcagaatttagactttttaataaacaggagaaaactatgaaagaagaggatttttggacagaaattctaaaatgtgttttatgtatacattaaaaagaacaaacctggatgttagagggctaatttgagggtaatttcaatagtgcaggggatgagcaatggaagcctgaacccaaatgggcatctctgtgatagagaatcatagaggaatgacatttgagaggcaggacagacagagctgactatcagttggatgtgagacatgaataaaaaacatgatttgactcccaagtttctggtttggataagcagttgaataattatatcattgggaaataacaagagtatcacattatttgagttttccatgtcttctaagcatgtagatttttagatctggagctcaggagagagatttggagtcatatatgtataagacatagagtgtggcagtggatcaaatagtgtgggcaagaacatataaggtaagaaaagggcttgatgaaaacacagtactgtcagaagctaggaggagaaaggaagtcatggaagagaaggaacggaggaaaagtcaagtagggtgaggaaaggtaagagtggggaaactattagaggaaaaaaaagaggtggtcagcaagtttgattgtcatagaaaaagaaggaagagtaggactgaaaatgtttgctggattcagaacaaagaagtccatggtgtcagttgtcaatgattagatagtcaacgagagttaatttagttccaatggaaatgtgaggaataggaggtagttaaagggcaatagaccagagggtttaactatatttcctgtaacaaatttgaatatattcgaacgctataaaagaggagccaaataagtgaaaactgagcagctaggtctccatacctgaggaatcagcaaccggtggaatagtacaaaagcaaagtggaagaagtagtgttaaataggaggaagcaagtcaggaaatacagatataaattacctgcaggtgtgagggctagctcttgggagatttcatgcctcaaggctcactttctttctttttttttttttttttctgtgcaataagatctgggtccatttccaacttttctccctatagctcacatacttgaagtgtgccaagaacaccagatatggcaacatcccacagatgatgaatggtatgaaaatggcctgagggttctacatcattcatatattctctgatcactagagatttattctcctatgttctctagcaaaatgattacagaaccacagcaataatagtggtctgctcaattagccaaaacatgctactgaaaccctttatttgttccacagaaagaaatgatctaaaaaaatcttttctgagggagtaggttttcctcctaagctgcatgtcatttagctcttccaatttcttctagtatagggtttatttcaatgatttctctgcctaatgtgatgctgtaacactctgaatctcacatctttcctcagtcattgatgtgctgatcgttcagtctgccagatcattaacaatgatttttttttaaagaacagttaacaccaattcttgcagtaatgcctaccctttaatctcccactgctcctaaaaaggaatcatccatctttatatgtcttttcatctatcattggtatttgtgctttgttctttgacagtttcagtcaatctgattaggttttatgcacagcaactcaatagcacaggataattatgatacagtgaggactacttttttttctgtttacttctatatgcccaacattctgttctgtaggcaatctgacaattggagaattttaatgcaaaaataatctctttaaaaaaactttcaaaaatttcaacctctattttagattcagggggtacatggacaggtttgttacattgatacactgtgtgatgctgaggtttggggacacaaatgatcccatcacccaggtagtaaacatagtaccaaataggtagtttttcagcccttccctcctccctctttccccccaactagtcgccagtgtctattgttcccatttttatgttcacatgtaccccatggctagctctcacttataagtgagaacatgtaatattaaagaaaaaatatggctgcaacatagtaggcaaaattcattttcaaggagatcagaaatccaattgattatagcctaatccaaataatttattatttaacaatttaacgagggggaaggggatatttccaaaacgtttaaagtttatttctcataggattttaaaattacctggcactataatatggaaatagagagtagcattaacttgtcaaaaattaataaaaacttgcttttaagaagaggacaaagggagtcaaaatggattgtctaaaatttaaatgcaatgttagaaagatcacttttgatgctatctggaaagtttcccagattccccattgagctaatctctgtgagtgctcattataagaagtgatagctatccctctgtctcagagacaggatttgtcttattctgattgacacagctcatgttatattaagtttgtgaaatgaatacaaaagctaagataacttttgtttttaatgacttgcacctttttttaaaagaactcttagggatgttataaggataaagtaacataatagatattttgctcagcaaaaagcatgattcagcctagcacagtggaaagatcatggtctttggagccaagaaaaaactgaatccaaatctaagtaacctcagctctgccactttctagctttatgacctcagataagtttcttaccttcttagcgcctctatttccccctgggaaaaacggggataaccagaagctgtgaaaagtaaataagatttgatatttaaaaccttgcctaatgctgaccacatctaggagacgctcaataaatgttaatccccccaggttcccaatagcatagcttttgaacaagtttatagatgccaaatatgaaagaaataaatacatattaaagactaccagatacgtgatgctacctagttaatgcttacatacagtaaatgctgaagcatacaacaaaatacaaaatgttttgtatttctttcccagacttgtagtggtattcttagttcttgagattactctaccaacatttattaaatacctgttttgtgacagtagagtataaacacagataagaaaccatctttgttcccaaggagtccatgatatactttaaagaaccacaggagattgaaattggcagaaaccctggaggtcaccaaatacctccattttttaaaaaaaatttattcattttatttttgttggtttttttgttgttgttgtttgttgttgttgttgttgttttacaaacccttgtgttgcgagggctgactttcaatagatcgcggcgagggaactgttctgctacgtaggaaaccccgacccagaagcagatagtctacgaatggtttagcgccaggttccccacgaacttccattgcgtgacgggcaagggggcagctgcctttgcggccagaccccgtttcccaggactaggggcactccgcactggaccctagtcctggcgcgggatggggcggcccccaggcggggatagcgggggaccgacatccgagaccagccaaggcccccctctgttttttttaaagaggagaaaccgaactggagaaagtttcaatgaattactctataccacattgctagttagtggcagctccagtgaagccttcctgactcctaacacagtgacttttcctttaacctggtcccccaaataataagctgtaaaaagatttactggaagaaaaatgcacaagaacttctcgagtaggtcagatttctttttttctctcttaagtataaccacatcatgtttgatccattgaatttctgtaatggtagtgtatcattacataaaataaaagtgaaaaagaaatacaacaaatttcagactgccttatgaaatacaatagctaagcttaaatattcacagggctaatcccagaaaaggcagtctggactcggttatccacataactacctctattatccatttcatattagaatgtagaattataacatagttaatggggtttcaatttaaagaccccgtgtcatcttattagcctatcatctgccctattttctccttaatttaccttatgtttatacaattcttatctcagggccacgttgctaccataaatcaaatatgccaggtttcaagtttcagcatatgagcacagatgtgagcgaacagcttttgatcactcagttatctctaccagagtaactgaaacagggattctcaacacatagaacttctaatccaggctgacctcaattaactgcaagctaatagacattgccacgatatcttcctagaagaacaaggggattcctggaaagaaaaggaatctatccgtctttcatcccactggtcaatacctttttctcagaatcaattattgacattttataatctatgatcttcaccaccgtaataagacttcaggaaaaaaaaatgtaatttcagcagaaaagattggaagcatggtactagggatactatacattggcacaggagaagataaatgtattgactcagcattttgttaccattatccttctctctaaaatctagttctgaataaataaaagcagggactcagagcctggcaggatatcttgccctgaatgcatggcccataatcgaagctttcaacaggactttttgggtgagtagataggaattaagggtccaaagaaaatttgggcactgccttccttttacattgatgacttaaagaagaagaggtacattagtaggtaaagaagaaataattaccaatttagaaagagggtacagagggtagaaaagaaatagtctaatgtttgcaatatgtttggaacatatattcagggtccaggagcactgcctgtatctgattccttgcttctgcttatccagagatgagtttagacagaggacaatgaagacagtactcagacagtacacttatcttctcccatcccaatatatagaatctctagtacaatgcttcaatccttcctgctgaaattgttttaacattttttctggagccttatgggagtggtggagtctctagatgtgtaaaatgccaataaagaatgcttactgggaaaggtattgactagtgagattaaagacaaatatgctcctcttctttccagaaattccctgtgcccctaggaggagactgtgtctgttaaataatgttaactccagaaggaaagatcaaaaacaagagagaacaatgaaaggatagtgctaagtgtgaaagaaaaacattaaggaaaggagtcggagggaaagtaagagtgttactgcattatatttaaaccagcctgtcacaaggagaaaagaggcagaaacatgtgtgcttcttgtctgaccacttatctaccaaatccagttcttctacctttaccttcatcgtttcaggctctcgtataggcaataaatggtgtcaaagattcagcaagttgctactatatatttatgaaataaattcacatatatttatgaaataaatacccatcagctttcacatactaaaataattagtgtaaaagctattacattaaattaaattaaattaagatttcattttctagcattaacaggtggctttccccttattccttattccatggtaacatacccttctaaaaataaaagtttcaaccagttttcctgctcttagttcaatgtcatcctaaaaacaaaaaaacaaaacaaaagtggccctaacacctactgggtgttaaaagataatcttggattagcagataagctttctgaagtgggaaagtgagattgagcaaggggaatattaaattgtcaagaacagtaccatgtgttctttctaagaatgaaaaacttagaaatttgctatcagaagtgaccacctctctaaatagtctagaacaaaaaataaaataatttattttgtaaaaagaaacatcttcccttcacggtcttcctccctttcctacctctgttcatcccctgccatgttcatgaggtacaaacaaaaataacagtaggattaacctggaagaccctactcatgaaaaatcatttatataaacgaggaagaaaattctgcccactttctagcatatcaaggaatattgttaaacgtatttaaaagccagtctgtgattttgcatggctttattaataatgttcttgagaaaacaaagccagtacatagataaattccttacatgatgatcaacaccaaggaaacctcttactgttctcagacctaacataaagaatgatgattttcattcactgtcaggtacaaaagcaataatatatgcaaaataggaatacaggaaatattgcacagctcactaatatactgcaagttactaatgggaaaaatatcaaaataccttaaggactattatatacattatcacaacactcaaagaatgaaaatcacttattcctttgaaaattgggatactttttattttgagagctgcagaaaaccctatgacgcactacatagctctcacagtaaatttccaggatcaaagttcaaaaacaggtacatgataaaatgagcaaagtgaggtagacaacagaaaatgccaaaatgacaataactgaaaatattaatttccaagtattatatctcataacataatagtaacatgatgtctcaccgttcccagctcatcacatgttctaaagctgttctcctcctttttataaaactttattatcctgctgaagtttcactcatacaactagtcattccttaattttatacttagttattccttagttattcttagttattccttaattttattttcttttaacatagttattttatagcaaaaatttatgatgataactggttttttttttttttgtactcttcttatcttaaaaacaccagttagaaaaaaatgacatttataacttgtggtctatggaacaagatcagtaattattccatgcaggataatgttagtatactaagtgagacagcatcatttagaggaaaagaggacaagaaaagatgatgatggtagaaacaggaggcagggtcagttatttccatattgatcatgtagaccgtgcctgataaggtaagaggtctattattaatcaaccaattcaaccaatgatgaaggctcaacagaaccccaatgtcagggaaaaagcattaaatttcaaatcccattatccaataagcagttatttatgaactacatacaaaatgtaaactgaatttctaagccacatacaactatcagtataattattctataatctaaatatatccttgactctaagaatatacatatttcctactacaaaaatttactcacccagtttactgataattaattccaccaaggttgagatgataaaacttcaagggtttatttcacaaggttgctttgtgtttaacttgaacaaaaaagggaaaataaacaacaaaactaaaacaaccattgaaccaacacacctgaattttcaggggtagaattttaggaagaaaacagtccctgacaagtacaaattctctacatagaaaactgcctattcggcctcagtctatacacaaaaattactactgcacagattctgtgtagtagcacaaatagaacaaaggtcaaagattaaatgtaggtatgtgcatgtgttttatatatattacaaatatagtaatatatacacacacattttgtattagcctatgttattctaagcattagtcttagcatatgctgtgtttcacatttagaaatccctaaatgtgttcagaactgagggatgtattattcataacttatctttaaatgtattatttaatgcagtatccatttgtaagttagtagatgctgatctcaccaattcattgactgtggctaggcatgcacaaatttcacataaagatataaagctaatatacatttccttcctctgatttccattgcccggatttcttgcactaaacttttctgctgtgttgcacatagtgcatgcagaatgcatgtagaacatgccctgaagaatctgcaatgcagataagaggaaagcattattcccaatttgcatatcacaccacacacagtaactgatttgtcaaatatcaaacaatttacatattctaggcctcctgctctccctttcttgagcgttcggtctactttttctttttgcaactgaattttatagagaggaaaatatatctttagctaaggtgatgtaatttgaaaatataagtattagatttctccaaatgacttaagaatattagaaaagaaaaaaaaagtacccattcagcttagattgcagaacagacagggagcttaaacagcaggctctgactgaaaattaaatttaagcttccagttactgcagcaaaacctaagaccaccttccctctgtagctcgagtgggagacattgttctgctgtctctctaggctctttggtacgctgaggctgatgtgattgcccagactcgtgtcctgcatggaatttaaactacttttgtaacagcaaaaggaatttactgacttcctctcagattgaaagcagaaatgaccactcgcatcaaattatttacttcgatttgtagcttatttaaaatgaggtaggttgtgattgatgttgatttttattcaatggctcatctattctgatatttcagtttcttaaaatatttatgcaaagttttgtttggattacttacatacgtagcacaaatgattctttatttgccatggtgacagcacaaatcacattatttgcagaggttggggagtcccacaaatcagcccccacaacaacaaatatttatttattgaactcttggaacagttacaaagaaatataagagacagtttctgttttcaagaaccttacaatatgggaagataaaatatttacagatacaaattaaccaataaaataaagacagagatacaagcaatgccacaaagccaaaatcatagtggagattctgccctggcaggaatgagatctcattacctgggtgaattattattcctctagttctcagtctgtctctgaaaaatgaagacgtgaactaaattttctcccaattcaacagccttaaaatttaatatgaattctcttacacctaaccttaaatgtcttcacaattgtactctatgtcttatctatggaaagggaagttagtagccaccaaaagatatttcaattgatctattttcccttggacattttaacagctaataagccaagaaatgctatctaatttccttacacatcttttttcttttttcttttttctttttttttttttggtgacggagtctcaccctgtcaccgaggctggagtgcagtggtgcaatctcggctcactgcaacctccgccttccaggttcaagcgattctcctgcctcaatcaggagatggtctcgatcttttgacctcatgacctgagatggtcttgatcttttgacctcatgatctgtccacctcagcctcccaaagtgtagggattacaggcgtgagccactgcactcggcccacacatctttatacaagaggagtgaagttatacacattgtagtctatcctacaattttttttttttttgagatggagtctcactctctctcccaggctggagtgcagtggcaccatctcggctcactgcaacctctgcctcaggggttcaagtgattctcctgcctcagccacccaaatagctgggactacaggcatgccccactacagccagctaatttttgtagttttagtagagatgcagtttcaccatgttggccaggctggtctcaaactcctgacctcaggtgacccgcccacctcagcctcccaaagtgctgggattacaggcgtgagccaccacgcctggcctaacctacaaatttttaaatgggattttgtttggaggggtcgttgagagtctatttttcagataaagaaaccaccttacctagttacaagcattgagttttctttccctgctaggtcctctaccttatctgtggtaccagccaaaaagtcaattatttttaactccgagaaaattctgactgcaaagcactgcctcttcctactcagtacagatgatcaaggtgggataacacagaagaatcttcacacccactcatcactctctctctctctctctctctctctctctctctctctctcattaaaagcactaagcggccaatgccttactgtctattccatgggcttcactaggctgtcccttcttaggcctagaacgaaatgggcttcacaaatagaaattattctaatccaaataatatttccccaagtctcacagtgcaaaacaccacagcagagagcacatggtgatcaagaaagacagcattatcataaacatttgtatttcttatgctaacagatcccattcttccagtctgtggcattgtcccaaactgccccatcaaaggttctaaaatatgcttagggcatctctattaagaggatgaggagaaaggaggagggggaagatgctaacaactaaatggtaagtttttacataatggtacatcctgccagccaacaagttttactacaaaaacaaacaaacaaagaaacaaacaaagtttacaaatcctttctcttttttttaagttttattgattctgctgaatgaaaacaaaaaacaaaaaataaatgtttatattagtcctaaatgtaagtttcgtaaattctaaatgtaatacagctgaagcaataatagtactcatttggctcacctaaagtgccaaaccatttacctcaaagtatgttcattgtacttacactgactatgtgtttcagttgtaaagaaaaataacattaaagagcaggtatagaaatttagtctataacacatacaaaagctagagctataccatcccctaaaacatgaagaactttgtaatactgctttgtaatggtaatataattactttatcatagtattctgttttctgggaaccaatcatcttttagaatattaaggtttggtcaaccttcacacaattaactttagtacaagcatgagaaaataaggctacctacacactaggatgcagtgttttccaaatacgctaatcttagaacactatacaaatacaaatacaaatttgcaggacattactggaaaaatctgattccattgatctgaggtgagatagaagaagttggaatttttttaagagtatctctagtaattcttattttctggcagacttgaagaacatttttataatgtactcaaaaccaaatactaagaattttagattatatttgccaggctgcccatcagtcagtatctatatgcatatcatttgaagaagcttgaaatagagttagcattaaaaatagttcctccattatctatcacacaaacagcataaattcttttgttttcatctgaagcactttttgctctttgaggatccttttctaaactgtaaatttcctggaaatgctaccagtcaatatctttgaggaactaaataatagtccttgaagagcaaaaacaaatgaaaaaataaatggtggtaagcaatggagaaaaggagtatgaaacgaattctgctaaaggaattgcaagatggaattgactcattttcccattgagattaatcttttgaagccaaaacaaaatccgaggaccacagatgtaaatgagcatgacttgtatatctatgacttgtgctagaaagggctatattgtcatgattacctcccaaatggtcaatgagactctggctaaccttccctaatgaccttatgtcatccatatatcttaggaaaagtaactccctcccctacacgatatctctaaaagagcccactgaccagtttccttaattctgtccatctttgcagattacagacacttagtatttaccgtttcaaaagtaagcagcttagtatccatcgctcctttataattccacatattcacgtaagaaggcaatgataattcaggaggtacttcaagatcagtcagtgcctcctggttattaaaaaaaaaactttataaataaaaaggctgtaccccaataatataaatttgtcaacaatgtggagatataaaaatttaccccagaacatcaggaagaaacatgtagaataaaagtactgaaatgtaacaaaagcagagatgtgacctataggttcctttaagggtaagcttttgtgtcacacaaagctaagtgaccaatgaggacagcaggatcacaccattgatccaccaagtcaatctgagcttcttcaatctctggcctaatgcttcattatagcatgaagttcccccaaaatacactaatatgggttcaacaatggcgactttttaaagtaaatgcttggctattaatgccttattggttccctaatagaaaagggcaatgctcatatgattcctttcttaccactcttccttccaggttcaatatgatgcagtatttccaatggcgggagacagaaacaatgtcacaaagtgggagaggcactaagaatgagatctggcaccacttactcttgtttctatacaatcgaagtacaacacttctcaattttctaggcgtctttggggagagatcttatctctcttaatggtaccaactcagtaacccaaactgttcaccaatacttcttttaagtagttgtgaggtagggagtccaacacttcccaagagatcctgttagtacattatagcaactacagggaatgttttacaaatgactgtcattataatgttaaatctaacatatatgccaacccccttagtttatacaataactttcctccaaaaatcttaattaaaaataaaatatagctgacttcgttataaagagactcattaaccaggacattgcagtttttattttatcaaatagaaatagtgaaaatgaaagatgacatattttagagtcagcacatcctgggtccaaattccacctctcctgcttcctacctacgcatctttgagacagctgcataggctctttgcatctcaactttccacataaaatgtggcaccccacatggaacataagtttgttttttatcccttccataggtgtcaccattagtacaagtattaaaacttctcataatttcccattgagttttcatattattggaacaaactcattaagcaaagattttatgaggctagagtaaaaagagagcagtcaaactatagacacagaaagcagtcatggacagagattcacaacagaactttacacagttcctgtccaaagggataattaacaaagcaaataggtaggtgttgttttaaccaaacagactaagataatgaaaaaggaaaactgcagctctggaaaggagacaatgccatttgcaggctagaaagttatggaaaattttctaagcaataaaaacttaacatgacccaaaatataatcaacacaatattttgaaggcagacaatgcttcagaaaagatgaataggatatcacttaccatgggctttgttctttgtaagaatttcctggtatttttgtgggagtaaggcttgggaatttcagacctcagagctaacagtgggcagaggatgaaagatgtacctcaaaggttcttaaaagccataaggatatcaggggtgtcttaaatttccccaacaacctccatatccctaatgataagttgccactgtaaatggctgttgtgtaatccatcatgaatatagatttagttattgactgggaattctggtcaaggaggaatattttcaggttttatttacactgatgataatgtgtttcctcatgagcataatactgtactcttgcctcacctcttatgttcttttgccacatgtaatatatgtatattatattgttgaggtggagatgaagaatgcttgtaaagtattggaaagaacaatgtcacgtttttatgtcctctgagaaaataaaagggtagtctacctacagcctgaaatacatactgtcgcccattcatggaatttatatcacataagagttgattaactgagctttaataaaatatggttggtatacaagttctaattcaagaactggagtgcctgtggacccactaggatgtgtttaaggaaaatatgtttgggaattcctttggtttgggtgaggcaatatttctctggcttgcagttacttctatgcataattggtcattgttagtcttcccaatgtaggactggattacaggaatgctcgtactacccatttttgcatctaattttatgttcacaattttgcattatttttcttcatgagggtctctcaaattgtataagcttcaggcttgtgaaaccaagatccactcctgatctgtatctgtaaacactgtacttcttaagcatcaaaggacaggtttgaataccatcaaaggacactcacaaactttctaaaatatccacattcctaaggataacaataagggcattccaaattaagtggcgacagaaaaataaacacaaacccaacagtcctccacccacaaaattacattatacagtaactttcaatcactatgatctcaagagctataattaaaatagcaagttcaagtactttatatgacaactatgatatgaataaatctgctagagcaggatgaaacaaaagacaaagtgtgtcatttacttgtataacctgcatcacctcaggaaggtgcatatgaggttacatcaatatcaagtgagagagcaaggattatgtggtggcctgagtgaatctgctcatgctcctgggtgcaaaagagtgggaactgactgagactgattatctttattccttcttgacagcttaattaagttctctaattagtcacagtcattaagcactacatcagcaattctgcctcctcttggattggcttcttctctagtctaattggttagaaaagttagctgatctaaaacattgtctttcaattttgggaaatcttctttttcacttttattgagatataattgacaaatagaaagagtttatattcaaggcatacaatgtgatgttttgatatacatataaattgtgaaatgattgccacaatcaattaatatatctattatgtcacatactgtgtgtgtgtgctgagaatacttaggttccactttcttagcatatgtcaagtatactctaagttattattaactatagtcaccatgctgtgcatggtcttcagagcttattcataactactagtttgtaccccttgaccaacatctctccatttctctcactctgggacccctgctacctacccttctactctctgcttctgtgtattcaatttcttagattgcacatataagtgggaccatgcagtagttctctttctgtgtctggcttatttcacttagtataatgtcttctaggtttatccatgttgtctcaaatgacaggatatacttcttttttaagactgagaatactgacccagcaacacgaggttggtttacttcaagaagcaccctcaggaaagttgtaagtttgctgaactgggtcctcagccctgtcctgatcaccattttaccaccaccaccacgatgagcttcttcttcactctctctcccactctcactattctctcagctattcatcctttcacactgtctcagtctcttttgccatcccttgaggaaaacaccaccaaagattgaagccaaaatatgagagttcatactctaccccacaaatcagttcttacaaagaagacttcaaagaaggtaatgctctcaaggatatcactttgcagaagtgatttcctataattccagaatgataggcaatcagcaggaaagataagtgattgcgcaaagttccccacatcatagacacacctagaaaagtacagtgtccccaagacctgtcatgtctttcaactaatcttttcttgcatgctggtgtctcttcactattatatccaatgcagtaatatatttaatacctcgaattacagttcctataatcttaggaaattattttgtgatcacatttctaatcacagcatctcatgaaacacccccaaccactacactgcaacaacttacaaaagtattctgggattatgcagataccatatttggtcttagtctatcacatcattcttactagagaactttgttctaggcttttgtcagataacatattgttttatgtattacattggtttcaagagaaattttataattcttattcttttttaaagtccaccacaggtacaatttctggctgtaaatcactactttaaaacaacagcagtaaattagcagtaaacaacatttgaagtaaattacagcattttgaaagaaatatctttggccctttctccactatattcagaactgagtgactggcccatgaactatatccctcctcacaaggtatcattcacatcctccattgccctgcaaggccccttttttttctgtgcgcagaagcccagagagcactttctacaagtttagggaacatgctgatgtagaaacatgaaggataaccacagtatacaagtagtgcaagctatttctctttttgcaagggttacctgttgtgtatctaaggaatcgtgactagacttgtaatgtctgcatcacagagcatctacaaaccagaaaatctgagttctaggctgttttctaatgattcttagacacatatcaatttctaagatcataaaatgaagatacttagtatgactacacctgcctatcttctaggcaggcgtcaaggacattgtaagccataaatcaccaaaaaaaggcaagaaattatttttatcatgactaaaaattttgttttccctcctttagtctttaaattctgctaatgcagccttctaagaaggacatttctcacaaaggattgataaatatctgcacacacaaatgagtccacttagtcttgagaatctaatcctttagtcataattatcttggtctccatgcagtctaatttcagagttctagtaacaaggtaacataacatccactttctaaatgccctcaagttggtcacattataagattaatgagccagatcaccattttccaaaaataaatacatagaaccttgatttgaattagctaaatgaattgacatcatgttagtgatgtcaaaaatggtagagacttctatttcagcagagaaaaagcaaaataatattttaagaccaatgaggtttaagaaaatgaggagtaaataaagaattgaaaacaattaattgcaaaaattggaggggtatttgggcacagacagattgtaagagacactcgatggcaagaatgaatttaggtcgaaggtaatatgaaatttagccatagaaaatttttaataaggatgatatgtcgtcaaagtatatttggtgccatttggaaaatgactgagtcttaaaggatttttaaatgatttcctttttttaaagttgtcatagtcagtttgttctgatcttgagaaagtaaatctgtcttctgatggtcaagtgatggtttccctgaacatccaaacttggtcttcatgaataaggaatcagaatggagaaaaatctgaaaatgcataatgaacttttcagtttagctatgttaatctgtctcaaaattaggagtccatgacttttatttatactaatgtatatttgcatatataatagcatgtatgtctttattttgctattaagtcattttgcaatgaagatatgtaaatattttaggtgccatagggacaccaaaaaatagaagacactgtttctgtttctaagattctacaaatatgttgagggagataaaattagcactaataagaatggcttttttaggtgaggcacgatgataaaaatgtcttttttaggccagacacaatgactcacacctgtaatcccagcactttgggatgccagggcgggtggatcacttgagcctaggatttcgagaccagcctgggcaacatggcgaaaccccatctccacaaaaaaatacataaaattagctgggtgtgatgacatgcgcctgtagtctcagctacttgggaggctgagatgggaggattaattgggcctgggaggtagaggctgcagtgagccgagattgtgccactatactccagcctggtgacagagaccttgtctcaaagaaaagtctttttaaaaaaattctgtaaatgtatacaattaattgccaagtgactaaacagaagacaagcgtatatgaaagtatgttctagtattgaagcactttcatgaaattttaatttatactcaagtacataaaagtaaatgtttccaattgtggcagaaatagccatgctcatcaaatattccagttagttttctaaatatcccagtaactttgcagttaggcagcaccagataacacattctagttcatgggcactagtggaaaggatttgtgtcacttctgggttaaggtagcaaaaatctcatgtgctgttggcagtttctctttctttaccatgggttcctgtctctctctctctctcttcttctaccatggccagtgaggagtctaggcatcattccagatgatgtagctagaaaactgtggtgcctctgtcagcctaggttcctgagtgactatggtccttaaaactaggtgtgtctcccagtacaaatggttgtgtacatatatgacatgaaaaagaaatacatttttgttttaagctatgactttaactagtttttttaaattgtttttgacagtgcagcatagactagcctatcttgactggtagaacaaactaaagctgtgtgaatgaagaaaaaggcatccagaagtgacctgtcaaaataacctcaaagagtcatgggaaccttccttagtgactcaatgaaattttattttaatacacttgaaataaaaattcattaattctattcaatcaataaaaaaaactaaggctaaaaattaacggtttggggaatagcagaatagtgaaaaataacagagctttgagagagttatcaccttgcttcctctatgatacctggcatattaataactaccaagactcagagaagctgaactgaatgaaagcattttacctttattctccccaactattagcttattgtccttcctttgcctccctaagaagttacatcaggtgcatattgctacaccaatatgtgaactacatgatgacagcactatttacaaaatagaaacgtttggttcatcagcaaagtaatttttagatgtggtatcagagttcctttattgttaactccccctgtcctgggtttttatttttctctctcctgcttctctccataccatttggctcttcttatctctgttctgcatctttagctggagtggaggctgcacttcccttgtcccttaacaggcatatcaaaaaatgaatataagggccaataggaaggctacctgtgaattgtagcaatgttttagcagaagagaaaggatgttccacagaagtgattccttttacctgtcctcacatctggtcaacataaaagggatgatgaaagagaaacgatatttcagcagttgtgtgcatattctaatatgtatctttgtttctaaatagttgatgcattctagcttaatccttaataagaaaggacagcttcattacaaaacaaattcctcattggcagataagcagatgagagggagaatatttaacattactgataaagaatcaagttatgttctagattcatgcagagttttatagaattggtgcaaagtattagaaaatttataagaaagcttatttactgtaaaaaaaatcaatcttaggaaatagccacccacacatttttcaacctacttccccaaaaccatagtataacccttagaaagaacattgaagaacagataggaaggggaggtaataatatctttaagaactcactaatatgaaccactttatatatatatacattatctcttaggatcatataacaaagtttgaggcaggtggatgatatttgtatccccattttatagataagaacgttaaaacccacagagagtaaattgtttaaagtcactcaagtactaaaccttactcagtgtgatcaaaagcccatattctttattgtaacttatagcatataagctcctataaggaaaatcacttactaaaaatgtcttctcttctgtacatgccagcagtgctattcctcaaagcaataatctgcatagttttaaaattagtggtgctaaatgtcagcgatgactcatgctttagcattatctcttaagtatgcaggtgataaactttaaaaattaagtacattcattgtatttcaatatttctctagccattctttttggttgaaagtgtgtgtgtgtctgtgtgtctgcgtgtagatatggggcattaaggcaggcaaacttagaacacaaaatataaaaattgggtggggaaacatctggatgacctcaatatttacctaacattcttctttgcaaatgttctgaattgtctcatcaattctgcatcatctctgcccccttatacacttttccctgcattgcctggaagctacactcccagaatttcttaccagcatggttccaaatttgattctgctaatgaggtacacttgcaaaagatttggaaggcagatgagaaagaaaaattaattttcctccaacaacagctggaaggcaggtgtcagacctgaagtttgtgtgggcttctgaaaatcaccaacttcagtgcccaggtagccaagatcagcagcaatttcctgcagtttttttagctctctcatatgctgagagttaatcgttttgtttttttttctgatcgttgtcttttaggctttccagtgctatgtaagcacctaatttcctaaagttaattacttctgacttgaaatattaagtgtgatttctattttcctaaccaaaccctgaccgatgcagtatgtccaataagaactcattatcagactaccaggaaaacatattttaacacaggcttacaagaaaaacagttaccaagtatggatgctcaagacagccttaaagcaatgcctagtaagaagtgctttataataactctgatgcaagatcacatgtccaatttttaaaagatgtattagttcacatttgttgcattaaatgattttggggaacaacatagcctgagataggacaaaactgagaatcaaactagataaagctgaatgtgataaaaatatatgcctttaaaaagttaggggtctcaatcaggagttaaattcattaaagaaaaggttatgagtactccaagttccaacagtgaggcagggtcaagagttcactccagctggcacgaacaggcaggtaatagaggacctaccaggtttaaatggggaggttatcactgtcagatatgaagtggctccaatgaaaggttgggaccagtgaatatctgccttagttttagataatgcatatgacatggctttacccactgaccagtgctctttcgagaataaatacttagacacctaatacgtatgaagtcacacagataattggcatgagccaaatgagggttacttgtactctatataaactcttacatactctcttatcagtagaaatttctattgagaggtggcttggagaagatctctaagttgctgaatcccacaaagactttaaaaaggtagaaaattctaaaaggatgatgctagcaatcaatcaaatactctggcctcctctagaaggaaactgatttgatatgtttatgggtgcatttaccttctgcacacacactcgtcagctaatcaacacaacaaaagtaacacagtcagttggatggaattttagagtcatctccctctatgcacgtgtgctttggcaaaatcaggtacaatatacctgacgcttcagcttttcacttaatagtgcacttatttctagttagcccttgagtcatcttcccagatgtgttagcctatcaacttgtttttttcatgaatatgataactacttatctttcatcttacatcattagaacatttgaattgttaaaattccacatatttcaatatgatggtgtcctgtaatctctgaagtcttgggttactgagtctgctgtgtgtctgaagctacactatgtattagcattcttgttaggtttaatttcattttctacaatgatccatcccttgaagctccacaaaaaatatgcagagcatatttattgctagtactagtgtaaccgaaattaccaaaatctatagaattttcataaatttatgtattttagaataaattattataaaaagaattaaaggatgtttaagttcacaataaattttacatcatctatagacactgaattattagtcagcaagctttctctataacatttataattagaaccaaataattttgactcttccccttagtcatcatttgtgttttaatttctgtccatgtcaataaggttattcacagaaggcaaagaaaaaatattttttaagggtttgttttgctaagttacatggggagtcagaaattcagttaagatgaactgtgtgaggtattaattgaaatttaagtgtataatattcttgagttaggtatggaagatgacagtaatttcaatctcacttttacttcacatacattagatgtggtaacttcttttcagtcagagggacagatgaattctctaggaaatttatatgtaagtatttgcaggtacctttaagctagttctgaggagaaaaaagttatatgaggcaagaagaactttcaataaagaaaatgcatgtaactgcccagaccctccttggagttataaaagagccatataatttccacagcttccatataccaccaacacttatggtcctacatagcaagtcccataaagcctcagtagacatgtgacatcccgaaaacagagcaatgcccatgatcctatgacatgaggtaagaaattcaaggcaccatggttccctctgacacctgataaactgtatgtatttattttttcctagaaaaaaagggtatttgacacatatcgggagacacagtttcaaatcccacgttgaccatacacatgctgtatggccttgggcaactcctttgagtctctgtttcatcatttaaaaaccaaggttaataattcctatcttcacagagttgtgataacaataaaaatatattatgaaaatgaggaggctttataattaataaaggtataagggcattgattattttctcaaccctttacataaattagtagattattctaatcttgtgacagagaaaataaaataaatattgaaaagtattatgacagaaactagctagcttcccaccacatctgttccatcttcttcctgggcccacaggaagtataagcttcccactctcctttacagttagaaatggcaatatgactgcattctaacatgaaggaagtggtgggatatttccagtcttagccaataaaattctccagtgcctggtcctccatgccctttccccaagcatgagccacgggaagagaactccaaggtcctagataaaaaactaagccacacgataaaggaggcatatatgtgaatgaccaaatggaaagcctcttactgaccaggaacaccagttttgaatttcacatgtgcaagttatgctaaaccagtgagattttggggtttgtctttgacataattcagtaggacctcaactaaaagagggatatagacaagttaagtgtgaaaaggaaataccaccctcaatcaggctgccattcaaaaaaaaaaaatatgccaccaagtatacagatgtcaactatgattgtcatattttgacaaaatattattagaaataataattgctcattttagagaactgatgatctatgaggttatttagggtctgtgtgaaacttttagttctctcaatcatctggggatcatgagggagctgagatgagatctaactttctcaataccatcaccagtgctcgtttccctatagcacactgctgtgcccactgaagtcactggctttttttttttttttttgagacagtcttgctccatcgcccaggctagagtgcagtggcaccatctcagctcactgcaacctccgcctcccgggttcaagagattctcctgcctcagcctcccaagtaactgggactacaggtgtgcgccaccacatcaagctaatttttgtaattttagtagagacagggttgcaccatgttggccaggatgatctcgatctcttgacctcgtgatccgcctgccttggcctcccaaagtgctagaattgtaggtgtgaaccaccgcacctggccaagtcccttgctttttaagatacagttagtcatgcagttcttgacaaaaaaaaaaaaaaaaggtacatacacaccaaccattacagaagccaaaatatcaagtctagactgacaacctctgcagctacactgaaaccccacatcactaaataataaaaaatcctaatgtgactttctcatcttgaataattgttaaacaaatattatccctcttcctttctgccttctactctttatattcttcattttggaaagttttgtttatgaactaaaatattcgatattatatttagtacttagacacatctcttctagcttaccatctagcagaaggaaatgtaaatagtgatgttatattaaaaatctgcctttaatttaattttaaaatgaagggtaatggtaaattaatatggaagtttggacatgagcaatatttatttggctgaataacaaaccctctttaaagtgaatcctgtctcttaatttaacagagtgaaatttatgtttttataggcaattatgtgtcaattcagagaatctcagatttaaaagtggcaaccacttctgaatgaaaatgctttgagtatatttgtgtgatctggatatatttttcccagaaagtcattatgtattcataaatgtgaataaaaaccacatatgacataagcatgtcatataataaatcttagcaaactatatggagaaatataccacagaagtgaaacaatttttaagtatgtgtgtatatttatatatttgtctgttcgtattagaatcattttatgacaaatggaataattcagtaaccactttaatactgcatgtttaatatttattgagcaataaaccatatactaagcaaaaagttactaaccctcccccaccaaaaatgatttgctcgtattcactttttcccttatctaatgctgcaaagataattactttgtccctataataacatttccacaattcatttcaggaccagtgattagtccacaaagtttggcaggtttcagatcagaaatatgtgcataaaaatgctgactatttgaaagataagtaaataaattaagataataatttagactcatgttccccaagcttatctaataaaaagaatctcctagctttttccttagagtacatcctaggtaacagctaagagtcagtattattaacaagctcttaggtgattcaaaataagaaactggaaaacatagattcagactaagctcaattatcctattcattcatttatgcagtcattcattcattattttattcattcaatctgggcacactatgtgctggatacaacaggataaataagacatactctcagtctcatgaataaatgcaatgaaatatgacaaacgcttggctgaaagtatgtacagggtccattggcaacacaaaggaaggaggtgtcaattcaatctggcaggttgggtaaaggtttgtcctggcttcacagggaaacccacatttaaaccaagtgtcaaattagtaggtaatcaatcaccaagtgaagaattaaagaacatcctagtaagagaaataaatgccgggttcattgtgcagaatgtatcagctgagtatcaaattagaagacaaatctttttggaaactatttagagaaataatgagagctaaactaagctgagtcagtggaaaatagaagagaaggggggaaggatatataatattagaaaagaaggtggattggacctgggaagtgactggatgtggaaagaggaaagggagggattggagagtccaaaatagctccaaggctgcataaaacacatatagatggtgacactattttcaggtaaagggaataataaaagatgataaggtttgggggaaaggtaggaattcagtcttgcatgtgttacgttgggggacattcgatggatctgtctgttaagtagttgaatacgtaagactagaaccctggagagttctgagtttagagacacagatttgaaacttaacaacaggtgaatagtgagtgaggtcttaaagtggttaaaatcacacaaagaattttatagtgtgagaagcaggtcaagaacagaactttggacagttcttatattttagtaattatcagagaaaaaaagacaagaagaaaatgagagtgacatcagaaaagctgaggggagagagttttaataaaatgagttatcaacagcaaatgacccaaatatgttagaaaaagactaaaataatccatcagatttgttcctagagtggtcagtgattaagaagtggtatgagtttggaccaggcattgtggcttacgcctgtaatcccagcactttgggaggctgaggcaggaagatcacctgaggtcaggagttcaagaccagcctggccaacatggtgaaaccctgtctctactaaaaatacagaaattagctgggcctggtggcaggtacctgtaatcccagctactcaggaggctgaggcaggagaatcacttgaacttgggaggtacaggttgcagctcagatcaccactgaactccactctgggcaacagagcaagacaggaaaaaaaatatatatatgtaaaaatatatatgaaagaaacagaaaaagaaaaagaagaagacaaaagaagtggcatgagtttaagaggaaatgggaggtaaactggcaacagtgaaagtaggctatagtctcaaacttgattagtaaagaaaaaagaaaaatatgcagatgaatgatcaaagtatacccttttttaaaaaaattagagaatctcagaattaaaaagagtttggataatcatctagtgcatttcttttaccccaatgcagaaatgccttccaaagtctcccttacatgtaatcatccaacttctttatttgaatatttccaagaataggaagcttattaactcaaaaaacgctcattgtaattaacttgtttttgaagtataagattttatatatattatatgtatacatatcatgatggtgaatattcataaactgaatacatctatgtaagcaatatctaaactaagaaacagatattacaaggtgtacagcagcccgccccaccccaccccaccccaccccacccagtccctgcccagagtaaacactatcctgacctaaatacatagattagttctgtctgtttttgaaatgtctataagtagaatcactcagtatatactctgttgtgtctgaatgttgtgtctcactcaacattatgtttataagatttactcattgttatacatggctgatattcattcactctcacaactgtatacttctactgtatgaatattcaaatttctttttacctaaggacccattgatgagcatttctgttttggcactattacaaaaagggctgtttgaacacttttgtacatcttttggttaacatgtgtacatatttctcctgcatgtatatctagaagtagaattactgggtcatgggatatgcattgtagatgccctcaaaatttttccaaagatgtttccatttatacacccactagcagaccatgagaacttccattgctctacatcgttgaccaacacatattttctgcctttttcattttagtcattctcgtcagtgtgtagtattatcacattttgacttaatttgcattagtataatgattgttgaagttaagttctttttcacacatatatatattgcaatttggatatcctcttatgtgaagtgtctgttcaagacttttactcacttttttattggattgtcttttgtctttatcttttttatttgcaggagttcttatgtaatctgaatgagtcatttgtcagatgtgtgtattaagaatatcttctcccactctgtgactgtcttttcattctcttaatggtatgttttgatgaacaaaagttcttagttttaatataaaccaatctctctctatatatatattttttatgtttgtgtcccgattaagaaatccttgtggcggggagcagtgtctcgtgcctgtaatctcagcactttgggaggccagggcaggcagataacaaggtccggagatcgagaccatcttggccaacatggtgaaaccccatctctagtaaaatacagaaaattagctgggcatggtggcgtgtgcctgtcttcccagctgcttgggaggctgaggcaggggaatcgcttgaacccgggaggcggaggttgcagggagctgaggtcacgccactgcactccagcctggcaacagagcaagaccccatctcaaaaaaaaaagaaagaaaagaaaaaaaagaaatccttgcctactccagggttacaaagatttttctgctatgttttcctctatttcctacctagttgccctgtttactatattctttttttctcataacttttctctgcattaatcaaacatccatttatttatttgtagtaacatgctaactacactttcttttactgttcttttagtgtttacctgaggaattgcaacatgcattcttgagttggttctatataattattacttttagtatcttcccagaattgctaaacctagaagttttaaacttcatttatcacttcttacttttgcaatggtattgatgtcacatattattctgtatgtattttaaatttcacaaagcatcactcttattgttcaatatagttcacattcatttgtataaaatgcatttacactctccagcattcttcaatcactcagatatttccaaggttctatttagggtcattcttctacttacaacaattccctttggtattccttttagtgcaggcctcatactgattaattctctgtttttgttttgtttttgtattttgggtttttttttttttggtcagaaaatgtctttgtttcgatattttcaatagatatatttgtattagttacagaattgtaggtttgcagttatcttctctcaacactacatttcatttatcttctcacttcttttgttaagtcaattctcaatcttgtacttagagctctttaaagttttttttgtttgtttgtttctttgacttcatttaagatcttgttatctggttttcagcagttttactgaaatgtccctatgaatgtttttattgtatttatcctgcttcaattttgctaaacttcttgaacttgtgtgtggcggtctttccaaaattttagaaaattcttggccttaactcctcaaaaaatgcatctccccgtgtattctctcctctcctttgggacttcatttttacttatgtttaaaaaaattagcataacacaaataccatttacacaatatctaatttttccctttttctttctatgctttgagtattttttcagttcactaaacttgtattatactgtgcccaatttatcatatgtccctagcaaactcttaatttcagatagaggtaggactttgttttgtttcagttcaagaatatgtgtttgattattatttttattaattatttttttgagacacagtctcattctgttgctcaggttggagtgctgtgcacgatctcagcgcactgcaatctctgcctcccaggttcacgtgattctcatgcttcagcctcttgagtagctgggattacagacatgcaccaccaagcccagctaattttttgtatttttagtagagatggctttttgctatgttggtcaggctggtctcgaactgctggcctcaagtgatccttccaccttagcctcccaaagtgctgggattataggcataagccaccatgcccaacctgtttgattattttctatgtgtcccacttctccaatcgaattttcttttccttcactttttttagtccaccttttaagtccttgccagttacctgtaatatctggatcatctatgtatctgcttcaaatgtatactttttcttttgattatttgtcatgtagtttcacctatttgtatgtctacgtactcttttattgtatgatagaaattagttaaagaagaactacagaattccaaacgatatcttccaccagagcaggtttctcactttcgatattaagcagaagagacagaggctggacgtctcaagccaaccaaggactcagctgggttggggctagattgcagttttagtggaatgtagtcttccccttgtttatctatacttgtaagccatgacactccctggattttgattgaaagcctggtatatctttatcttctgggccctgaaaaagttctctttcagaagttttcagctcatttctttatcttagggccctaacagctacaaaatttggtaaatatcttcaaaaagagttcaatggtatgtttgagtttggtgtctccaggctgccaagtccttttgtttgtttatttcctactaaaattctactgccttttggaagctctgcctttggcttcctatgcagcctcaaaacacagcaaacatcccttggagaaagatgtgtgttttagatccctcaagtctccagtttgtcccagccttgcagtatcactaaaagttttgctaacttttcttactccccaaagacaccttccgcctaggcccagtccagtcctcagaccacactcagaataagcaaatgccctcagggaaataaatacatgcatgccttggaataattttcccttctgaaattttagttcttttagtccttgttgcttccacagctctaggaactatatctaatttatttggtttgtacagaaaaactggtcctatgacctacttgaaaatcaaagctattacattttaatagctctgattagtttttaaaactctattgacacaaaattgactctcccatattttccattaattggctaaattttgaaacctggaacagtattttaccttcaaccatattgctttttttcatctatttaagattatctcccttaaatatgtttttccttcagtctaaatatcaccaaattctaaacttctattttatgtttaaatcctttgccatcctgatcatcatcttcagtaaaaactctcgtttgtcaacatccctcttaaacaagtatcaacaaaaatcctagatgctatgattaagcccaataaagagaaaaaatgagagagtcatattaaaaaaacagagatacaaaataaagaggaaaaaaacgagagaatcacacacaaaaaataatagagatacaaaagaagttatctagtgaggtgtttttaaaagcacatgaacaaaagatcaaaaaaaatcaaagacagataaacaaaatagagatcaaaaaaatgaaatgaaagcttccaaaattctcatgaaaaatgctaagcataatgaaaagaacattttgatcctttctaagtctttgtttcacaattacctgaattcattctcacaattcaatcacattttactgatgagttaacttggaaaatgttaagtaacttttgaccaataacaaaatgtaactaatagcagagtttctaggtttggatacagatatttatttcgcacagctacactcagatctactgaattatcaaaataatgccaagtagccattttaactcttttttttttttttttttttgagacagagtctggctctgtctccaggctggagtgcagtggcgccatcttggctcattacaacctcctcccgagttgaagagatcctccttcctcagcctcccaagtagctgggactataggcacgtgccaccatgaccagctaatttttgtacttttaatagaaacggggtttcaccatttggccaggatggtcttgatctctcgacctcatgatctgcccgccttggccccccaaagtgctgagattacaggcatgagccaccgtgcccagctgccactttaactcttttttttttttttttttttttttttgagacggagtctcgctctgtcgcccaggctgaagtgcagtggcacgatctcggctcactgcaagctccacctcccgggttcacgccattctcctgcctcagcctcccgagtagctgggactacaggcgcccaccaccacgcccggctaattttctgtatttttagtagagatggggtttcaccatgttagccaggatggtctcgatctcctgaccttgtaatccacccacctcgggttcccaaagtgctgggattacaggcgtgagccaccgcgcccaacccactttaactcttttcatacaaatttatctagagaaaatgtccttctaagaatagacatttctattattcaaagagaaatctgtgtagattctgtcttatgccagctaaagacatgtatataaaaccacaaaatacattcttaatattatgaacataacataatttatttatgtatgtatgtatattatgaattataattcatttatgtatgaaaagcacacatttgagaatcaagctacctattaaaatggtctatatttaacacacagacatcatgctgaaaatgggtagctctctacctcccttttgcatattaagcaatatctgtgtaattgattctctctcttttggtacttaaagatgcatttggcacttgagaaagctatcttcagcttctaacagtaagtttgtttcctagagctgtttggtacctgaacaattcagatacatttgtagttactaaggctcagagaagagggatacaaatttggttgttttgtgttgcttctaaggatttctgcacacacacacacacacactcacacactactatttaaaatgctcttaactgaacaattttaaagaaaaatataatggtcagaaatcttaaattaaaaaaaaatcaaagcctactttatccataagtaggtaaagcaatggttacatttaaaactgtattaacaagaacaagtatttcattccaccattaggaaaagagttaccctgagagagatgccagttttacttaaattcattgtaagaggtaaatgagagcagagttgacttgggtctgggcacaagtaggacacctgccactattaagatggaaaagagataagaaaggtgaagttggaaatacttaagattctccaacgtcacgagactacatacttgcagttctgccaatgtttaacattttctcaaagtaagatatagacaaagtgctccagtctaggaaatcagatgggcccaacctaccactaggaggaaaaggaagctatgacattctgaagtttggcacctcgtaagtgcccactactattaattgcattgaatatgaactgaactgtgggttcactaaaagcatgcttctggagttaggaggccttggcaaatgaggctaaaaattaactcacacattcaaagccatctatttttaaaatgcatgataagcaacacaggaagcttttataactagccagcaaaatctgagctttcaatcaacaatttctttcaacgaaggtgtggagcatggaaagaatccagaagcacagatggtattttacatctgcacatgcaatttcctttttctccatttttatataaacctctctctttttttaagaatgatagaatttaccagtaaaatgcagaactacttaattgcctctagaaatgttcacacctccatttcacatttttagcagcaatttaactgcctttaagtatatgtagaaagatgggagggtggaccttttaagctcccctgtattacaaagtgaataatttcagaagattcaattcctccagagagctacaatttttccagcacttaaaataactgcactccaccatccttatctctaactattttcctaggattaatgctaacttttcactggatcttaaggctaaaatgaacttcagagatcatgttacttcagtcctctcctcaaaatatgagtaatcatgatccagtagggctggcagcttgttcaaggtcactttgctgcatagcacaggggaaaggagcaaagtccacctgcatcataatccacaatcacagagacaaatgtaggaagaccaatacatagctgtgtctccaagaatctatttccaggactccatcagaatgccaagcccttcttcttataaagtaagtcagattcatttgagcacatagagaagcctgacttttaaaatctaaaagcgtttctttaaaaattgaatacaaataacaggtttcactgtcatattacattcaaaccaaagataaataaggcatgaaaataatattggatagaatgaaattccaggtaaccaaacatggtacaggggactgaatttgtacatttaggtaacggggaaaataaaaatactacaacataaactaagagaaactttcaaaagcaatgttcaacttacctttagaaaaatgctctactgaaataaaatcaattgacatatcctctgtttttcatactaattcctctggcccaaacctctctcttgagctctagaattgaacaaagtacctccatgacatctccattggactatgtcaaaatctcctcgtctttatcacgtctaacaccacactcaccgccaaagcaacttgcattgtctcttgtttcaggcaacgcccccaacatgaagatatttgtgcatccagaaatctaaacattcctctgagacctcctaatcccttcagcaaatcctgaccctctacctcaatcactcctgaaacctgctaaatttcctccatctctgtggccactccctgcatccacactgccatcttgcttctctcatggatcttccagtagcctttgaacagctttgcacatgttcgctctggacctttgttgtccctcctctccagaatgaacttttgtcaatgcaaaccagttcttatcactctcgtgcttaaatccttcattggcttccactggctttatgataaagtctaaatccttcaaaatccctaaaaatttataaaatggtccacaaggaactagtggccctgatggctttttgagtcccacctgacccagtccctttgccccactcccccatcctgccatatccctgtagtctccagtccaaccattctggaccctctgtcccctgcctgcctctcatcctttgcacaatgttaccttggcttgaagcatgcttcctcccactttctacttgattcattcatctcaactcttgtgaaactttcttaggaaaatcttctatgatgcaactccctgaaagactggttccctgtatttttcctctgtaaccaacatcaaaatttgtaatcttatatttgtataactattgtttaatgtgtatccccttatgataatatctatttctatttattcgctcatctcactagcacctaagacagtaggtggcatattatacatactcaatgatcatttattaaatgaatgaattaataaagagagaaaattactaataagagacaaaattaataaagaaaagatagaaatctttttatctagatttctagattaacagaggaggaagggaaggggacagagagagaatataagtgatttacaacacaaatctcaccaacagcttagaaagttcaattttatgtgtaactatctgttactttggataattctgagctagtaggatacatcctaactagaccacagaccagggtcatacttggaccaagtcaatcccagttacccaaacttcagtcagcttaacagctctctctcaggagtaataacctctaacaaaggtattctgaaagtctccaaataaaagaacaccacttttaggttctttgcttgatctcagtaaacatcctcaaatgggcatgaagagtgatcttcccccaattcaagttctggaaagacttaatgtgtacttccaagactgtaccactatagtgcctactaactggccaaggtacagtgtcaaaagccctaaagcacaattgctctaaagtttatgtgtgtgaatatttgttctgtaaggaaatgagaaagaaaatgatcagaaagaaaaatatttgagagagggaccaacaaaatgttactccccttaaattatttaggaaaacaaagtcaaggcaattattatgatttataaatttttttctgataccttttttattattattattatttgagaaggagtctcgctctgtcgcccaggctggagtgcagtggtgcaatctcggctcactgcaacctccgccccctgggttcaagcaattctcctgcctcagcctcccaagtagctgggattacaggcacccaccaccacacctggctaattctttgtatttttagtagacatggggtttcaccatgttagccaggatggtctcaatctcctgaccttgtgatctgcccacctcggccccccaacgtgctgagattacagatgtgagccaccgcacccggccctctgatgtcttcttaacatcacaattctcaaacttcagagcaaggttagcaggacacttgtaattttgacaatgcaaaagcagagagagacagaatatgccaatgcaatgcagtagaccacttcatttgattatgtgacttagaacactggcataatttggctcccattaagagttttctgaagtttggatacaatttctaagacactcttaatccacttcaactagaatgtacactatgaatttcaagccaccaataattcataatatctgggaggaccaggaataatccatatttataagtttcagagacaagatttgcattccccttttggtttctctgatgttctgctggctgtattttttgtgtggggatgtatgcaaggttaacttatgagcacacgctgtgcacaagaaactctgtgttatagaacaaggggaagagtcctaggaatttaagaaactatcataaatacagacatcatggccatgtaagccatggcttggcttgctgccagttctctgccacagttgcagaaggaacacagcgatagggcagttcctagatataatatctaacagatgagcaatctacataaaacatttatttctaagtttagaaaaccccaataaagccaataaattcgcaaatatctcccgaggatcagaggaaacaatagaaaaggcaaagtattacaattaagcatctgtgttataattaggaagataaaacataacaataagatagtcacagcccagcgcggtggctcatgcctgtaatcccagcatgttgggaggccaaggtgggcagatcacaaggtcaggagttcaagaccagcctggccaatatagtgaaaccccatctctactaaaaatgcaaaaactagccaggcgtggtggcgggcacctgtaatcccagctgctcaggaggctgaggcaggagaatctcttgaacccgggaggcggatgttgcagtgagctgagattgcaccactgaactccagcctgggtggcacagcgagactccatctcaaaaaaacaaaacacacacacacacacacacacacacacacacacacacacacacacacacaaagatagtcactaacacacagcagcatgtaagaagtgtcaagagaggagtaaaataaaaaattgctgtagttagaggagggtggttgtacaaggttttggttttgttttgttttctccaaagtcttcctacagcatgcagaatttaacctgcctcttgctgggatccaaagaggcagggagggcatggcaagaagaaccagaaggggtgacagccccaagtgcttgtatttcgttaaaaaattccctcttctcaagaaagaaaattattccttttacgtgagctactggattgttttgcaggctagagccattttctgctggattgggttttgaaatggtatttttccatttattttacagtatcttatgggggtggaaagagaagtatcagcaggttaatttctacctttcacagagaatctgctgtttacaatgtaagacaaaactaccgaagtatgggacacaattagggaagtcaggaacacatttaaataaactgatgttaatgaaaaaactgaattctgcatataattcccacttagaatgttaggtcccagcatcgcaatacatctactgacatgagatttttttttctcctcagagaggaaatttatgttttattatttatcattcctatgcttaagcttgcttattggatttattcaataggcatcatcttcatcatcttatagatgtgcatagaaaaggtgaagtaacggccgggcatggtggctcacgcctgtaatcccagcactttgggaggctgaggcgggcggatcacgaggtcaggagatcgagaccatcctggctaacacagtgaaaccccatctctactaaaaatacaaaaaattagcccggcgtggtggcgggcgcctgtggtcccagctactcgggaggctgaggcaggagaatggcgtgaacccgggaggcagagcttgcagtgagcccagatctggccactgcactccagcctgggcgagagagcgagactctgtctgaaaaaaaacaaaaaaacaaaaaaacaacaaaaaaaaaaaaacaaagaagaggtgaagtaacttacctaaagctaaacaataaatcagcatcctatattagaatcctcagtcccttatatttaccctagttggatatttggcacttaaactatgatgctttccagtaataagccaacaattttaataatgtctaaatgtttctctctccttcagttctgacagacagagcttatacatttttgagcacatcaatttgattgcatctcaaatacagattaatgtggaaacagtaataattattggagaaatgactgttggcagggcatttaaaatgcttaattctctaagctcatttcaggtatatactgaacagtgatatgagagtgacaagcagtgaaatatgtagaaaaagaaaggacatgaggagtttttcaatcaatcagtagtaatacaatcatctctttcacttattgagaacttactatttcaggaaacacaaatatattttctctagcactaacaacaaaactgtaagatgcagattattatatccatttaacagtgccaatattgtggctcagagaggttaattaacttgcccaaggtcaccaatctaataaatgatataaattgacccattgtttccaaccctattgatagtatctgacttcaggctctcatcatctctcgcctaccattttgctatgcctgtattctcatatgtatacctgtcactgttgctccatatacattctttgctcctgccattttgagtagttctagtctcctggaccagctatgctgtctcatgcctctgcacttctgcctagaacagtcttcctacttttctctgaatgagttccttgtcttccttcaagactcagctcaagagtctcccctctgaggtctttcctgatcctagcccagcagaggtgatcatgccctcctctggagccagtatatagccctgtttattcactagtttactcactagttatgtttatatgcatggatccctattaaagacttagagctccttgaaaacagtattcatgttttatctttgaattaccagcacataacacagttcctgaaacttaatgttcacaaaataggagtacctaggctacctttgttagaagtttaagctggacccaaagttgattgcagattgcagtcagcattctcaagaaccaattttctttcaatgctatagagaggattttttaaaattaaaaaacagagaatttttatattacattttaattaaaaattggatctgctactccttcatttgctgttcatttcccctgttacatttattaattatcaaatatattagttggttttaaccgctgcttgctcccttgtagtccatctgtgctttcttctcaataatgcattgaagtcataagtgctagatttattgccttggtgattttcatggcacaaattgcgatttcgctagcactgagcagaaggaagagctaataggcaaggcagaaaatgcctaatcaatatcactcctggcataagtttaaaaccctaaacccccaagcagattttgcaaagggctatacttaaggccataatctctagaaatgcatttactatagtaagaagttgagaatcactttctttcctaccaaattctcaattacttcacaagcctcctaggaaagcactaaggtctttgaataactcagctggcccgcaggagaaaaaaggaaaccgtgcaggaattagataggaatatgttatttccaagaagggccctttctcctaaagatacatccttttttctaaagataaaataaagtacttctacatcagcatagagaagaggatttctgaatatgagtgttaaaagacatcctaaggattagatatcagtcatgaaactgattggaggcatgttctaaactgggtagtctgggggatggaccacaatattatgagtcaagcaactaaccagattttgttgactagaagccacccacctcctatattaactacatcaatgaaattaagtgctcatgaggcattaactggattgctgaaccagacaggcatttctgctatagtcatgagttctaccagaagccacctgtgtgttctcacaaaaaagcaggtgttcacctaagggtcaggagaggcaagtgtgatcaggggaccagtgagcatcctggtataaagaccttcattactcagccttttaaactttgaatccctttaaatatccataggtctacctaatttgagaaaaaaaaaaacttcctttattcgaaaccacattgctaatgtcctcaagtaaaaagaaagtgtctaaagtgcaggcttagcaccataacacaaatataagccaaatagctgccttttcatttaatacactatgaagaccaagcaatcaatataatgattaggaaacagttccaatcagttattcaatgttctttcttggggctaccatctaggaaatttgtctcagtgcaaaaaaaaaaagtatagtcctatcttcctggccacccccactaaagcagaataacctgatcccactgtgttatgtttcgttgtctacctcaacacatttcaacaatgtgctaattttaactacatttgagttatatgtgaattgtttttattttttagaatttgtacattttaattttccttgagaagaagctaagaattattcagatactagacagtgatagcagtttcacaataagaacttgtgcatgtattaagcaaccatgtggctttccctctaccctatcaataatacatatatgtctcagtttcatgtcccttaataaataattaagaaatcactaaaataaacagccaaggcattcaaaatacattagttctccccatagacattgggatggttcccattacatactttttaagagtctgatttacttgcaaaagctacacatattttattaaaatgtaagtaatcaaagcaaaatttaaaagcacatgaaaagaataaaaataaagataagaaaaatctaatcagttctctattaggaagggagagggacacagtcaattcagctagaaatataatggtttccaaggtcaatgccagttcaaggaagaggttcgttgctttgcaacacttttcagggagaaggtaggatcaggagctccagtgtttccttataaacaagcacaaaatatgatatattaaaacacctatatttataactaatctcaaattcacttatcacttttaacttggtattcatatattcagaataataatagaagctcagagatttaagcaatctatcctcatatgtattgttccttgagttatcctcaaatggttggcaaaaatctacacctggagtgagaattccacaaatacttacagagaaggaaaaataataggaagaaaataccaaagatgctcctgttgggcaacagtcactaaccatgaccaagttaaaaatttttatattatctaattgactatcacaacatcatgaatacattttaaagctaaatctgaagtggagaaccaaatattaaaatatatattaatttaaatattgtttataattctactctaaatttcattcacagcagaacaccctcagccatgagaaaaaatcattttcaccctttagattagaaaatttcctgatcctacattagatttccttaaccatatatttttacaagattcatgatcagtcctgcctttccaatcttactacttgggtaacagatactttgataacttttataatggacacttaaataacagagtaaatagaatgagaaataataaattattgctattactcataaaagcataagattaagctttttcatagagaaggctgtatcgcataaaaaatctgcctagactacgtttataaattaaggttcatcctttccttcattgctgattttatatcattcaggttatagattagcagtataaatgataggatctaataataagaaaaccagtttaaaataattacatgaaactccttcatattatgttatatttgtgccttgtatgttataaatatcaagacatgtcaaaggagttaaaacatattctctaagtagggtatcctaatgatactgaagatcttaaccttgagcttcaaatttgctgtccaaatatggtctgaattatttttaatttttaattgcattcaatatctactttgaactgtgagtgaaaagcaaataattacattgttaatgagacaagatacactatcaagaataacacctcacattttttatgtagtttattttttaacttgttttgatcaaagccatagttgaaagaaaattgtctacatatatatgtggctgatcacataatagtaatcaaaaatatgactagtcttcttgtttattatttataagaaacaaaagaaatactacatcctatgaaataaagtaagaaaaaatgaaccctaatttgtaaatgctagatgcaactgtgaaaaaaaaaatgagagggactaaaagtaaaaaacataggtaagacactgagaagagctattcaccacatcaccctccaatattacctccaatcagtcaacgttagtcaccctcatataatctatgtgtgctcataaaatttagaagttgatctttattaaaatatcaacaagaagtattttattgcataagagctgtattgtcagacttacttttaaagtttatgtttgtgtcatataaaaatttgaaataatgagttagtttacctttacatattagctcatcccttattatgatattttcattacaaatgtaaatacatagacttggttataatctattcagttccctgccaatctttccactctcaagaattttcaaacttttactaatacgcaagcctgcacaaaccctgagaagtctttattctctattgaatttacaatctagagagatagattatgttaatatcaatgaaataacagcaatatataaataagaccaacctggccagcttaaacatgacgttatctatataaagcctcatagcaacagcagaagatctttccctccactctcatcatatcctacacataattccaccctaggaacatggtgtttaaaatggcttgcttgtaaaatcagggaattggtttcattcacccaagatctctaggatattcaataatgatggatggatatgatatggacagatgaatgagtggatagatggatagataaatggatgaaggggtggaagaaacagtatattttttttcatacttatgtggatataaatataaattttgaagaaattcatagcaatacctcatccctataaaatgaaactcatctgaaggattttctttaaaaaatgttacttgaactaaaacaggtgcaagatttttatgcaacctggcagatgcatacagaatatcacttcatttagttgggacagaatatcacttcatttagttgggagataatctcaaccaaagtctcaattaatttagtaatgaagttgaagagaaattcaatgcttatcagtaagtaatcatatcatttgaaagcctgtttggatgtcagctgcttgggttcagcaaatcctgaaatgctcctctgcaatatccaagtcctgccaaagcaggacaaactatttttagatgaggcatgtcaaaaacgtagtctgttttataaagaatgtgaagactacatcaatatagtaaggaagaaaatgccagttggaaagcaagtgggctattagaagtcatgagacacacacacaaacataaatgccaatgttcagggaaatcatatatagagcctctctgtgagaccaaaataccctatcagtcatagatatggagagttctttccaccagttgcttctataacaattccaaacactagtatctgttatgtttgtttgctttataatttttaatataatgtaattttcattctgccatacttatataaacctagaccaaaaacattaactgatgtagtgttattataagaccctccagtggactgttgtgactacaatttccaaggggattaaaaaaaggaaaagaagaatgagatgttttcatactgattagcaactgcacctcattgcaccacagtatgaagaaacggatttggaaacacagcaccaagattagagaggcttttgagccatagtttcaatttaggtctcatcactttacctggcaatagtaccaatttagcaggcactgggctgtgcagaaagatttacatgtaaatgaacacactttggggcattttgctttgcctcagttaaagagaaacatcacttttcattggcactacaaaaataaaacagaggttaacacagaagggtccagggaagagtccattagtggaaaagctaatttggcagctgcatcaaactcctggagatcatgagcagtgcttctaggaagcactaaagaatttgaaaaacacagatattgtggaagttattagatgataaagtgtacacataacattttgcaatttatagggggaaaatcaccaaattaagggatgattatcttatttttaatattcttttaaaaagttttatacatttagatacacaattcataccttctctaatataaatatattaaaataagtttaaaataaaataaagttttaaataaaaataataaaggatttttaaatagttaaaatcaaataaaaaataaagtggatctcaaacatcataatgcagtgccatgtgcctcatcattagtgtggatttctgctcactcattttagccctctacctctaagctaatgtcataatggcctggatccttacataattcgattttaatagattatctcagtcatatagttcctataaagcccagtcaccgggggatggaggtttgtgatttcttctcagactatattaactaacccttactcttttctttcattcattcaagtattcattcattcaataaatacacatatagtgcttaataagtataaggaatcatgtgagacaatataaggcatggagaaatatgattagtcatagattcttgtgctcaaaaaggttatggtctaatatgagataaaagatctgtgcaaataaagacataatctaaaaacagacatataataatatcatgtggaaataccatgataatttaaagagaaagaaagcaagaacaagagtgagagagtaagtgagtgagtgaatgagtgaaaaattgagagatgccaaatggggagataagaaatgcttttcctacatggaatcctctgtcttctgcttgctaggcatgtattggaatggcttatgttccatccagaacccttcaggacaagaacttggcatatggcccagagaaggcattcagcaaaccttcactgaaggaatgagtgaataaattaacgaatgaatatttctctttggttttgtagacattagcatgtgaatttataaaaacaatgcatatagccaatccatatttattttttcttgcaaaactgaaacaaaatgcttcataaaacacaaaatatattcaaaagtggccacatcatttaaatagttaagattttttattgcaaagataaacggtgcctgcattacataagactctccctgttacttagatggactaggggcattactgaaagacaaatttgcaagacacccataaagctaccaaaattcagaatgttttttccttactctaaatgcattttgatgcaaggagaactgtgacctttcaaatagaactcttaagtttttttcactttatattttaactttgcaggatttcactataatgaagtttttgcacaaataccactaaaagaattattattatgttcctgcaaaaaatattttgtctctcattattctcgttacagacacttgaaaatctgcaaatttatattgagttcctgccttattatcctatactgtcagccctccatatccataggttctacatccataaactcaactaactgcaaattgaaaatatacaagagaaaaacaaacaataaaaaataacaatacaattaaaattaatacgaatagaacaatacagtataatgactacttagatagaatatacattgtattaggtattatgagtaatctacaggtgattttaaatatatgggaggatgtgtgtggattaaatgtaagtactacacaccattttatataagggacttacataaacctaagggaccccccataggttttgctatcgggagtcctagagccaatcccccatggatactgagggaggactgtacttgtgacctcagaatagtaactgttactttagttggcaatttagctcttaagaaaatataaaaattaagtaccagggcctggattacatttaagaattataaaggttattttcaaatgttaggtgtttaaatttaaagatagacaacataaattcaggctcttaattatgtgcttcttgaaagtgctttcttaaaaaataatttactagtagaatcaagataattaaaattaatgatccaacagcctgttgtactcacaccaattaaccattggaatgctaaagagttctaggagatagattgctcttcgaacaaataaatcagtttcaaagtaaagtatattatctctgtgggggagtctataaagtaaatattgaatcacttctcagcaatatggactcttgccaataaatctcaaaaacaacattattttcaaagaaaaaagatggctacctcatttggcacacataaaggatgaatgatatagttagtcgaatcagccaatcagagtatacatatgtgtatatacatatgtgtgtgtgtgtgtgtgtgtgtgtgtgtgtgtgtggacagaaacacatatactgtatttgtctcctaggccccccatccattgccttcctttactatcttgcaccatttgtccatccctttcacaagcctataattttgccagagagcagaaattgtgtcttcatcatgtttgttctccatttcccagtcctgtacttctgcagcacctgcctagctatgttttacataaagaaaaaattcaagacaagtatagtctcatatgaaacaaaataatcaaactacagattaattcaagtttctttttgcacattttgttaaaaagaaaagctaacatattttaactggaaaatatctgccaatttctaagtcaacacagggatctaactttaaaaaccccaaaggtcttcctgaacatttttacacatatatgtatccaggagtatacttaaggttcctgtccccatcttgagtgttttcgagattggactcttctttctatgccttgtattggtcaatatgtgtgtagtaagaagcagagaactctgattttgagctgtcactatcttacccacatcttaaatccatcataaactacgtttctttcctgaagacccaatgtgcaaagaagcatcataaaactacagtataaacataggaaatcttaatgttcacactaatggaaataagagctaaatgttgagaattagtgttacagagaatcagatgcctatattgtgttcacctctctaggttctaaggccagtaagaattagatagagtgatagataagcaacaaaatgtagtggttaagaaggcaggcaaccacttaggcaactcactagacgagtgattttatacaaattatttaaactatctaagtcttccttttctcaactgttagtcttagaaggcttaaaataggcaacctctgtccagcatgtagtatagtacctgtgctacatagtaaatgcttaatgaatgaaaataatgaagagaatattagagacgtgtccaggccacgcatcaactgacagacgcaacaaatgcccacagcttcttcaggtggctaggcagagtaacagctgcagaaatcctaaagaaactaaggtagaacctgcggtaacatctaggccgtccctgacactttgccagggacccaagctgcagtgtgataattgcttacactatttatctcatatagcacttatattttatcaactgccttaacacttagaaaccaaaatagtgattagtgacaaaattttcaagctgggagtcaagccggtagaaaggtattttcaatcaagagtttcttaatattactcaaataataccaaagggacagctttctattttgactctaagtaaaactaccagcctgtatataaaggtcaagcttcataggacaaaataaacgttgctagccaatctccaaacacacatcaaattgcgcataccttagcaaaacccaaagctagttatgaaaatcagcttatataaatgaaacagatagtagaggcatcaaaatgaaaaagaataaagtcatcatcaagtgtattttttagaaattaaaacatttctttaagtaaattgagaatttaaagacagtgtgatacatacacaaacatacatgcataaatatatacatgtatatatttaaggaatatatgtaaataatatatttaaggatgccaatttcccagaataaagtatactttaaatcccacttctttccaaagacaaagaataatgcttcagacatgaccaccccccaaaaaaaggaaaacaaaagaagaaagtatttactattttctacatattgcttacatttaaattaaaaatatagctaatttcctccaggataaatttataaatgcccagttttattggcaattctacagattagggagaccagtcatagtcactaaggtgaaaaaggtaatgatactttgagccgagatagtggtaacagagatgagagatgtgtgtgcctgtcattgatgtcaagaaagtaactggcaaatcatgggacatttggaacaagagacagggagtcaaagtagatgggcaacaagtagattaagctgacttaatctaataagtattccctagaacaaaatagggaccaaggaagaggaaccagtttgtattcagagataatgagctcagtttgaaacaaatttaaagacaaattagagaaatatcattaactagaagaagactgaaatgcctatttcttattttatatgttagtaggtagaaataaactcaactgaaaaccccttaagtttagtagatgaaaaataaaagtaagaaaatacgcctctgaatttcaagataaaatgcagaaaaacatttcgatagtgacaaggactacatctaaaaaactgaatttcttcattaagaagtctgtttctttcactgtatgcagatgatcaaaaatgatatttacaaaaaccctaaactatcatcttttcaacaacctagagagttagaaaacttactagataacattcagccttacaaaaatgggaagatttcccctgtgatatatgaggagagcatgagaattctctcaatgagtagagatatttatacatactaaaatctctattcagacataacacttaccaagcaaactagagagagaattctagagaaggaaaacatggcctttttgttattccttcacaaaagaagactgtcattttctgttcttcagagtattttgtactttaaaaataaccttttctatccaacagaagagattcttgagtgaccttaaccaaattatgagaaattcatatgaatgttcatatatatacaaagatatttgtacaaatatacctagatattacttatatagttaatatgtggtaaaaattattatttttacttaatcacaacttagaaactttaaaaaactattcttatcctttataatcacaaactcaaatattacatatgaatgggaaaaagaccattagtaattagttatttttaaccatctaactttgtactttttatgtgaaaggtacatagcattgatgttgatacgagacagtgatatgagacttggcacatcactggaaaattactgctagggcaaatatcattgatgtcaagacactactagtgtagcagaatcgaaattattcctaagggaatttcctaaataatgggtcagctactactactcattattacaatagcatataacgattttcttagctaagagtatacatgataatgctttctagagagtaagtttttatacccctgaatctccacaattcatagccttaagaagaattacctttcttggaaaacggtgatttagaggattaaaagaaaccagaagtaatgataaacaggagtttagcagggtaaattcatggagagaaacttaattctcagaaagatatgacaagaagattctatggacactttaaatagagccttccaacaaaagatctggagaagcaaatgccttattagatttaaatttcctattgcccttccctgagcctattccaactagctagttcagacacttagggtaactgtttattttatgaaataatgtatttgggtaaccttcaggtaggttgactaagtcatttattgtcaaaatgggacgataagcataaattgggactgtactgttgaacaccctaatctcaggagagaccatgttaataaaaattaggtaaaaatggagaaatagagagaggttactgtgaaaaaaagaaaagaataaaaggacccaaagtcacttgatggttatgtgaagagaatggaatttattgtgagttggtgacaggaagggatctacaaggttgagtcaaacagatttgtttttttaatgccagctggtagcctctccattactacccagcgaccagtcattttttggtgcaaggacataccctcccaacaaaactgaaactcccccccaacaaaagattgctgaattcacagtcgttgcccaaacctctgcatcaggtatttaccctggtgtgaaaaataccatatgcagattttaatttcttatcattttagatttagtttatttgaaacataaataggtttcatcctagtcacactcctttttcaaattatggcactaacacaaattgtcatttgccatattctcaaacaactgactataatttgaaagggacggataatctcttcatggaagaaccaaagaatacctcttaaggcaataccgtgatgtcaggcagcaggtagtgcactgctacttgagcagaaaatgtgttgcacactcagcatctgacttcctactcgaattaacttatgtaaaaatctaataccctaagctgagaaagtaatcaacatatgatgttgatatagagaagaaaagatattacaaacaatatatgtaatatttttcatgaggaagacttgctctgacaaagaataattttctcattataaataattagaagcaaaaatatccctcccttacaaatttagataatagagactatttttatttttattacatttaagaatcattgggttcctaaatggatatcctacatggatattctaacgaaataagtatttccagatagcatagccttttaatgtcatctcattaaacagtgaactaggtcttttaaattgaagtaaaatttattttcattctacatattttaaaatacatgatagcaattgtatttaatgtaaacatctagtaaattattatttatagtaattgggggaacagtgtataattaaaaagaaaattactggccatattctatacctaaatcacttggtccttccactgatatttaggttcttcatattgtcaagcatggtgcctcatatatcacacagtttcaataatttttatccatctgattagccacaaaagaataaacataccttgtactacatctgtatacaatacttataaattaaaaattgaggaagaaatgacttaaatttaaccaaatattttatatattaaaaaattatcttacttgacattccaataaaattgtcagtgcaaaatattcataattcaacaaagacttacctgaacacaatttgaaaaatttatgagtaaatgtacacacatgtgcatacatataccatatcatgtatatatccataggtatgtatactatatttacatgaatcttatatagatgtcatgagtatgtaaaagtggtccaaaactgatgtatcaccaaaatttgcattttccatacctgatttaaatgattttgaaactataagtaattggctttaagtttatacatatatgtgtatatacatatatgtttatatattatatatgtatctgtatgtgtgtacccctatatatacacatgggtatatatccaatgctaactctcttaaattttcaaaatcatttaggtcaacctgggaaaaatctactgtgatgctgtattcagatatggctagctgttacattctacttactgatacatcttactatgttattttattgttaataagatagaatcaactttaaaatgcactctcaattacatggaaatgatatatgttaaacattcacgttgcttataagttccatcctaatttcagaaataataaaatgtgaaaaaatgtggatttatatttaaacagtataatcatggcataaagtatttcaaaataagacatatccaacagtaagaaactcactaaagaaaataatatgtgggatttttaaaacagatcatcagagctaactatttaattgataatggttcaaattaggacttgcactctgcataccagtcagtagccttgatacattaaatcaagcaggaaattgtgtgtgcacacacacacacagaataaatgtatcatggtttattatttttcataaatcatcaccatagaaattacaaattattcacagtagagttaattctaagtaagccagaaatgattctgcatatatgaggcataagtttccatgacgaataaggacaagtatataaaatcctacagatatatgacccataacacattacagagcactgatttcccagaggataatgtaaaactcgtgtacccagtaacagttctatttttgttctcttctataactcaaatctattcatgctgcacatttacttttacataaaaatgtattttagttatctgggctatttcatctgtgacaacaagattcttatttattttaaatggaagtatcctattttattcttaagcattttctttacgatctttcagtcgccttgaccattttttaaagtatgtgatatctttcattcacgcatcagataacttcatgttttaaatcttaaaaatccacataaataggaagagttactctggaattttcatttaataagctggattacatttctctaagaactaagctatatatattttatatgccgaaatattcatattataagcaaataatcttaaaagaagtgattagttttattttttatttttttgattacttttattaaagagataaaaggtaatatttgctccaggaattttcactgaagtagaaatacatgtaagtagaactgtagggatggaaacagaagtggcaaagacggttctaatgcatggagagaaggggaaagaatgtaaagatgcagttaataaaaaaataatacctaggccttctatttttcttagctttggactctaatctcagctaagatcagaaaggaagttagtctgatgtgctcaaacaaatatacattctatctgttcaccaaacaagaatggcagaagcttttatcctccagagaattcaacagcatgaattagtaattaggatattaaaccaagatcaggactgaaggttcctgaaatctgcctactttttaggacaagtttttatcttattgaaaaagaaatgggaactatctctagactttgatatctgattatatttcaggctcccctttgtctgtaactgtgtttcccttctcaccatggtcatgcttgctttttccctcacttttagaacttgctttctttagttggcaagggagtcccttcctcatgtatactactggttccttcaaactagcatcatcctttgatgctttttggactttcataggaaccatagatttttcctgggaattctctatgctcatctaaattttagatatatggaccaaactacagacattaatattttaaggaatcttcatgataaaataaatattaagaagtcatgggtaagaatagccagaatggcttgtctagataattctcttctgcaatggttatcgaagtgtggtgtgtggattaatagtccagcatcatataggaacttgtaagacatgtggattccaggacctataccagacctactggatgaaaaacttgggtggcagggggttgactagttaaagaagtgggtggtgatttttgtgaatgctaaagtttgagaatcactcttgttctattgtatcctaaccaaataataggataattaacactaataataataataatagtgtttatcagttctaaaaacacaattattttcccagttagcgaaagcaattttctgactgttccaataaatcttttatcattttcagaaccatgtaggctactacttatccaaatcttctagtaaagaattaagcagtttcatcccaggatttaaaactgttgcactgatctcaccatataggaatagggggcattagcgggataatatagggacacctgggccacagggccacagatataaccatggaggttagtcaggtcagcacttcagtctctaaatctttcccctaaagttgtccatatttttataactgacttttctcatgtcatttttccccagatacctttatcaatgaatgtgtcaacctttctggcatacgaccagcccacaataagttactgtggggtgcatcatgaacttctctcccataagtcctttgaaacgaatgcacaggaagatacgatggaaacacacctagagactgagctggacctgagcacaatcacaacagctggccgaatcagtgaccataaacagcagctagcttaactgagatcattggtagccaggggttgctaccaaactttgtaacctcaaggacaaaatgaggaagatgtgttcattgtggactctaaaaacaaaacaaaacacaaaatcccctgttcaaataaacaaaaaatccaagattgattcatgaaataaagaagacatgaattgttttaagtctacactttgtaattagctaagttgtgcagtattttttgacttaaacagagtatgaccctgaaaaataaaagaatctttttttttcaaaactcatcctacctacctgtaaaaactgtacaaagctaatgtatttttcatattgtaaagtttcaattgtagaaacaactggtatgtacagtaccataatttaattacattttactttaaaaactttacacatttcagtttctaaaattttaaattaacaaaaattatttcttgtgttattcagagttactcagttttgtaaggactgttttgttactgcttttgtgcccagaaaccttgactctaaaattctgtgctgtgcgaaacatgcacgatttttattatgcttactgcgtagaattttatctacttgttccagaaataatacattaaccaaaaaggatttaattgttcagacttgtaagaggttcttcaattacataggcaggtttttcttaaaaatgaaaaaaaaatcaaagatttttttaacagttctcagacttaactgttgccttgaattacagcctagtttctaagcagtgaaatgtaatgataaagagggatattttaacatatttccgaatgaatgactcattatttcattcttttgagtaaccattgttaagggttgggggaaagcatggacaaaacatcactggaaacaaaggctgtaaccacagcaacagactttgtgatacagttaaaaggtgcagctgccagtgacaaataaaaacttttgttacatctcattattttcaggccaaggtgggagtatagtgcataataattgtacagtagcaatttttatcctaattaacccatagcggtttacctaaaagtaaccatcagtcagtgcaaaatgtgcctggttcttaagacaactttttatttagaactgtgagaccggtattttggaaacatttcaaaggaaacatatgaatttgttttgcgttgtgcactacatcatttctctcctgaggaagaattttaaacatgtacagctcattcaatatagatatgagccatggtggagaactttatcactcaagtagacggtaaacatccttaatatgttctaaattgtttatattgctatccataatgggattcacctccaaattatcaaagaaataactcagagtaatttgacaccagcccagatcatatattgattatacaattgtattataaagttcattcaaatcaaattaagaaaacctgagtctttagaagctgaaataatcaacttgtttgtgctgtttgcttgacataggttattgtttgaaaatattgttactttatcaatagtaatcatgcattcttgtgtttttttttaatggaaaactgcaagtttcaattactgttgcactagaagtgctttttatgttgtcattttatattcatgccatcaaaagtagattgacaatacatcaatctaacaggggccaatcaaaacaatgaagaaaagaataactgaaaacaatgtcaaacttttaaatttttatctcttccaaagaagttatatctataaaatctagttttatgcaggtttgtcacagcaaatgtaaaagcggattcaagaagaatgaacttaaaaactgtggagcaaatttttgttgaaaatatataaagtcagaaagaaaaaagatgtaaatgttggaagaagcaaattctattactaattcaaatgaaactaaatgtcaaacacagtacttgtgtcaactatttagcatcccagattttgtaacatattttgcataaattatttgctcttcaaaaatttttgtcattttaaatctaattttaatctttatgttttccattttctaatttccttgcaatgtattattcttattcttaattctctacattgaaatttggctttacgtcgttagcaaatttataaagggttataaagctatgattcgtgagtctaaaatcaaatgcaaaattttatttattatgtaaaccaaaatgtcatttgcaagttttctcattagaagttatccttgcaaagatagaaaaagaagaattaatttgtgtaaacaagcacaaattaacatatttgttaataaataggtttatctactaataaacctatttctagacacattcaaattgataatgatttttagaaatgttaaggttccaaggagtcttacaagtgtatgcccttgatttcctgaaggaaaccactttctttcttaaatattttaaattcatctaaagtgaacgactataaatagaagcaatcaccttggaaccacagctctgtgcaaccaaggccctaagctacaccaaatacgccaggaattttgagacttctcatctttaaattcaaccaaaagggtctttagcaagaaaaaaaatgctggatgatgattattattatttttgcttaatttttattttgccatgtccaggttaagggtgagggtggtgacaatctgaaagactgtgtctggaatctttatcacatatttccaatttatttcagtttttgtctaaaacttgcatttctaacctatcttttccagcatttgataatctcccatttcctccttctaacccccattcctatgtctcccttcctgtctattcctcaccgatttaaacaactgaaatgtttacttatgtttggagctgaaaaatggaaagtttcacccagcatggttacaataacagccagcagctgcagcaaaccataaagttatgcagtgttttgaagttcacaaaccacattttacataaattatctcattttgtcttcataacaaccctatgaagacacattaatctcaaagaaattgagctcttaccccaaaacacagggccaataattggtgcagttgaattattctcaaaatttacaggctgttagtctttccactgtactaaaagatttctttctctgatcagagcaagagaacttccagagataatggatagaatgaaagaatatatatctatatatatttgacatgttgtttagtaatccctattttaattcaattctccatctgtaaaatattagctaactgaattatttctgtgttctactctgggctctcacattaaaactctgttcaaaaagtttaacaagtcacatatttcttaacatacaagttcgtttgtgaatgtgcagaacagatgctcccaagatgtggatgcatgtaggccccgaggtacagacataaaatcaaggaagcacaaggaaagaaaccccaaggaaaaaaccaaagaccttctaaattgagactgcataattataaaagagatccatagtacagggttgaacacatgttcaacactttgtcaactgaacacatgttcaattcggagctaattgggaagacttacataaaattctttttctttttttcttttggcaagatttcttcttaaaccatgaaattttttttacttgtaataatagagaacaattttctccattttcttataagaaaaataaaatataatttatccaaattgatgtatagaacctaaaacatatgctaacttgcaaataatatattttactgatcaactcatttttgtcaagtctctatttctagtccctcctgaatgttttggaaaaccacaaaactatacagattaatacaaattacatttttacaaggaaagaaaacattcccaaatttaacactcaagactaatcacataatcctattttgaactcagatctctctgactccattgactgcttagaaatagtaaaatctttttgaaaaaaaaattttctaaaataaaactattgtatatgagagtaaaaatatatttgtttttgattgttcctgactagaagacagatatcatctctcaaactaaacactcaaaataagaaattgaattcatgaaaaccaatacctgatgtgaattgttgttattcaactgtataaaagaaatgcagatgttctgggtatgtcagagcatgcgaaagaagaagttatgggactggcaggtatttggcctcaggagaaaaggtgaaaattttccagaatagatataataacatcttatattggcacagctcttaacagtttataatgctgggtaatataacaatctcctaattcatcaaaaagtctcaaggtgcagatgaattggtcttgcaataagaaagagcttccaactcctcccatgaccttcccaattttccccaactgtctctaaatagggaggcgccaagtacaaaggacccaggagcaatgctttcaaaattctgatttaccccaaaggtagggtacctggacaatcaacaattgggcttcattttatcatcaacattaatgggaaagaaatgtttaaaaatttaaaaccaagcaaacacacacacgcacatcaaagtggtgatgagtcttttttgaaggtctctcatgacttgcattatagttttattgtgagataggaggcaacttatatttaatttatttagggtaaatttcacattttaaaaagtccaccattgacttttttattctatgaaggacagtgatcttacagcagcagagtgcctcaaccatctaggacttaggctactaagtttcttcctcctagctctcatttataaattttgtgttatatgatatttgtcttcctgaaaaggtgagtgaaaatttattttgtgtaaatcaaataatatttcaaatgtatcaagagaccttgtgataaaggaaccttgaaattgctttttaatctaaaatattacctgctaatttatcttttttaaattgatttccatatatcttgtgttattataacacagcacacttgtactacatggtttaaaggttctgcaagacagtcttttcctcagtctataggaaatgacggtctgattccaggttttgagttggtcagttgagcagtttcagtcatttccacttactgactttatctggattaatgtggaaaatagtagtaagacaacatggatggataaatttgacaaataattttatttgtttaaacttttgccacctataatatccttgaagttactattaagaggtcaagttgactccaaatcccttgtgtcaatactagatttactgaatcagaaccactgggatggatcccaaaatatgcattaagacatgactgaggtgatactaatgcatgctaagttttgaaaaatagtgctcaaatgaatttatttttcctaaatcattcaattgctttctattctaaagtaaaattgtgaattcttgtgctttcccatatcaatgtgaatctagttttctaagcctgactgaacatttttcttgactgaggaaagcataccaaaagacaactatatataaaatgctcaggttgcttcctgacagactgttgtttatagattttattccccattaactctttcgagaggcatatctgaaaagtcttaaggcttctgggttagttacttgttagttgcacccatgaatataacaactgaaaagctggaagtggggagaaaggcaggaagtaaattatgatgtagcaggcactatgccctcctctcatttttaaatcattttaggaaagaagtataaccactattttaaagaaaggaaaataaggctcatagtaattaaataatttgccaaggctcacacagtggggttgaagattcaaatctagatttgttaggctctaaggatgtgctcctacccccatcatagcacattttcaaaagtgagaagagattataatcaacataatgaggcttatatatattattctgaataatttatacagaattatttattctgtattcagaataaattcttattctgaacacagcagaaaaagaatttgcctatttccaaatagaaaaattatcttacactgtgtagagacttccttcaatatcctaaaccagaggcctaatggaaaaaacaacaacaacaacaatattttcttgaagttttatacatggttccctaaaaagagtagacatttgaaagaaaaatccttcaaaacataaatacccttgaatattgatgtcatatttttatttccaatcatcttagcccttttataaatttacagccaaaattacagccaaaattacagccaaaattgataaagaaatatcaataatataaccttcaactggctgaaaaaaagaggtcaggttgccaattttaccaaaaactatatggatgaatggtcaataaagtcaccaagtacaaatgacaaggtggagaaaaacaccaataatctacagtcgcaaactgtagcaatgacatggcttgagctacagaatatttcctgtgagtgattttaaatggcaatattccttataggagtattataacttacacagatgatatgggatctggaagcatactacatcaaaagaggctgaaagataacctttataataaggcagactctacttgtcctactcagaatgtaatatgtagtttaaatataaaataaatatcatttccttgtttcattacttcgtggagatggacaaataaaattattttttgaaacttatttttaaactcacatcttgaaaaacatcttcctcagtctcagctattcacaaatgattcttaagtagactctcgactccattagtgtctcaggagctttttattaaaccattgagttatctcttctatctctccctgaactccacaagtgcaagtaatcccattggtttaattacattagcattttactccatcacaggatctgaacatatagcatccatgaaaaacatacttctataatacacacagcattcaagagccagtaaagcactctgtaagtcatgcctcctactaaaaatgatcacgtctataactgtgataaaaactaggctataaatttaaaacaataaatccagcaaagaaagaaattctagcacactggatctaatatcattgtgtcttctcattgtggcaccattaccaccatacagaaatgttatctgaaatatctagaataattctgattgtggacaacaaagatgctcctggtatctgggttgaagatgtggtaaaaaacaacaaagaagacaaaaattacacataccaaggtaagtgaagggcatgtgatttattattaaataatctgccagtaattttaaaaactaagacccattattaaaatttacaataacatttatgccatcaagtgtcatcataaaggctaatgtggatatttggaatataagagaaatgtggtatttgtgatggcaatacatattaaatgatagatagatagatagatagatagaattaattctaccaaaagagagactattaagaataaaaattagtccaagaactatttctattatttctctagagagaaactgaatagacagagaaaaagatttaaactaaatgctacatgttctttccaaggtcaaatttgaaatagtccaaaactataaactcttgaattgctgcttcaaccatatgagtaattacattaattcacatacaccttgtcaaaacctgatgttgagaaatgaattgtaattttaaatatactccatctgttcttgctgttttacatcaatgatatatttgctttcaattacagatccataaatataatgccctaaacagtctgatgaaaatgtggtgaaagattggtcaccgctgtttttctgttctaccataaggcaattatcagagtggaatggccaccacaatggggagctggaaatatgatttttaaagtcctctctagaggtcttattttatattcacttataaattaagaaaattattgccttgaggcaaaagcctgagagcccataccagctctagtctgactacacttacaccagagaggtctagggaaagacactgaacatctctgaacttgcatattatctggagaaaagactgagatccttgtgatgtcaacatttttccgcctttggatgtgatggaaacttaagttcagtgtattggacatccttcaaaactccctgccagtttcctctttaacaaacttcaaacctgagtttcttgagccaccattggctttgacacgcagctatttaataatgaatccttgttacacttcatcattttgtggaagaattacacaactggggttgtagcccttagcggcttttcccttgcctttggatccagttatgggataaaatgtgtgaacttgacatgacacattggtactaccacaggggtactggaagaagagccttctaacagataaacattttatgtaatataaaactgaaatgtagtttggggccacttctttttaacttaataatctgatatagttttcagataactgcatgcttttctgccactgagaatataaatactattgtctgtaatgaaaacatggttttgttgtcatatactttcgctttctgaggacagatttcagacaactgattgtgttctgtaattaccaaaaagaatgtctatttagtttcagaaagaatggcttaatgccaaacactttaagacaaaataacaactaacacttactgaatgtttacttttctaagcattttacgggtgttcattcagtcaacattaatatggcaaacagaattaataataatcctatgaagtagatactattgtttttcccttagaaagataagaaacggatgcacaaagcaattatataacatatagctattaaattgtgcagcaaggattcaaatccagttgactgatatattgaaaaactgacccctctaactgctcatttaaggtccactgtatagaccccaatgctaagttcaaaattctacctatttaaggctatcactgaagacattttttcaatataattaatgtgtttattacatacctaatatatgcctcttggaaggtaagaaaattttagagatacatgagtatatgacatagtccctgtgcccaagggacttacagtcttagcaaagagaaaagacatccatattcaacagaaataaaattcaagaactaagtttaatacctgcaatcataaacagcagttaggagaagataaaatcaaagttaataagtttgttgggaatatctcaaggcaaaagtgataaatgacatagaacttcaaactagcagtgaattcagatgggcaagacaaagatgagagggcagtgaagggagaatattatatttttatttactaacatctattattccaataggatttgttaaattcatgcttctctggaagagaaagaccaggctcaatttttgtcctgattgcctaaaagctcagagccaaattaaatctcttggcctttctaggcaagcctacatatttcccacatttttctgaactctaattctctttacatttctattttatcttctttgaggtgggggaaaagaatattaatcctttgtttaaaatgttatgtcagtttcaataaaatgttcatacaacattttgaagactgatccaggcaatggcattaatttcaaataattatgtgaattaaatcaaacaactttttagaagctaataattgtaacatcctccaacaaaatactgtttggcacaaatgaaaacacggcctttagattgattgactttttcttttcaacctttttagtctttatgttagtattggtgaatattaaccagaatttttatttcaaagagtaaaaataaaaatcatttttgattgctacattttacaaacaaacaaactacagtagaatattattaaagaccatgatcaaaatcatttaggtgatagtgagacagccaggtgtgagggggtccctggcaaaactccaaacaggtctgcacactgggaaggtgcactcgggtgcagtcacacagaggttccagtccatttgcagcaaggaagagcctggcccctcctcttcctgtgtggaacttgggattcaagcggccaagcaggaagtgctctagcagggactctggccttgcggagagtccctgtttcccccttttcttccttttcacccaataaaaccctgtcttactcaccattcaaattgtctgtgaacctgaatattcctggccatgggacaagaggcctatctttagctgaaataaggaaaagtcctgcaacaatagcaaacagaccagtactagaatgtacatttacttataattatttttcactagagtgaaatatttttaatttatgaatgcactgacattaaagaatatgcagaattatttctgccttaaaagtataaataattgtcagtaaagttgtcatttaaaaagtacagtcaaatatatatatttctaatctgaaacatgatacataagaagctactttagtttttttgaatttttttaagttgagaaatattctcttcatcaaattctggacaattaagttacagttacctctgtgtttatttggtaggtacaaattttcattcacgggtatttgttcaatgtgtcttctatatattttatactatataatgatattttgatatttttaattcaaatcaataaaataagcatttattcatttttattatggtattccagtgactatgatgtgagacacagtgatcaaatgcttatagtgaataaataattgtgactcaatgtgatatttctaaaaatgaagtctgtacatgatgctgtgaaatgattgggtttgctgaaaatcagaaaagacctcacagagtaaatgctacttgagaaactttaggtttgccatttataaaactcaggtctgtctacaggctccacatccagatcctaactaaaatttagaagtctttagatgtctgtggatattatcatctggaaaactgggactctaatagtttctgagtctagtattttccccatatagctactcagttttttctagtatatatgtcaaataaaattttgaaaaaattaccccttcccacaatctttgcaaattaatcctcaaatgaaaaggatttaatttagctattccatgataaataaaaaatatgcaattttattgaataaacttaaagtaattaataaattcaatgtactgtcagaagttttctgttttgttttgtttttaaaaatgtccattaaaatgctacctatgtgggttaaaaagcctataatacaatttctaacttcaggaatatgtgacaacatgtagaaagggtatattgggctgtgcaatttaaattttcatcacctacaggttatggcataagactgatatgaaaatgaatgagaattaggttatatgtagagtcttttgtcttttgttctattactataaaatatttcatttaaaaagtagggaaaaaattactaaggtggtgaatttgcctgatataccaataagcacagttgttttggaagttgcttggtaccactgactttttgcttctttaaataagtatttctttccttagcaaacacttctctttatgagaataccattactctcaaaagattccaatgtttattttgtgcttatggcactttttaatttaaattttcaagaatgcactttgcattaagatgaaccaaagtagtattagtgaattcagcaaccagttcaaggcatagttttctgattttcctacttaagaaaatgaaggccaggcgtggtagctcacgcctgtaatcccagcactttgggaggccgaggtgtgtggatcacgagatcaagagatctagaccatcctggccaacatggtgaaaccccgcctctactaaaaatacaaaaattggctgggcgcagtggcctgcgcctctagtcccagctactcgggaggctgagacaggagaatggggtgaatctgggaggcggagcttgcagtgagccgagatcgcgccactgcactccagcctgggcaacagagagagactcaatctcaaaaagaaaagaaaaagaaaatgaatatattttaattttagaatttcagaacatgtccgtattaactcgaagaaagttatcatgaataatgctattttaatgaatgctgagggaattgtgcctaatattctaaaatactcttgagaattatgaagagtgtgcagtatggcaaaggcagccatgagaattcccaatatataaaatgtatactgtattcaaataattatttctcaaaagtataaattttcactctagatagttttctacagggtggcacatgctatgtggtagtaaatgagcctgtaaaactgaactcattagacaataactacttctattaaatacctaaaacacccttaatgtgaatgttttgaatttatttttatatgtgtagagtctataatttgttagtgactataaattaaattataacaacctttagcttttttaagtttcacaattgttctgtattccaattaagaggctcaaaatctagtctgggaaactccacttggcttacaaaaaaaaatcaatatgctttttatttcatggggctctgggattgttaagattagcatgaaatactgacatttacactcctgagtggactagaaggggagcaggatggaatgatgatggcaagtaattggacaattggacagtttccagaaaggctttaagaaatactattaaatctccatctgctgattgaaaattccaggttcataaggtataacaatagctgaaatacaagccttagatgatctctatctttcctttgcaggtttgtaccccacctactttgcaagaacctgtgacaattttttaattaaaacatctgcataattaaacattttaggctaatgatgacaagaagacaggccatattttattacttttgttgaactgcccagtgtatattacatttgctataaattaattactcaaaatcctgccttgaaaatatctgttataatttttaaaaaaagaaaataaggaaaagagaagaaatagattaaaaattaaattagggtcttacacttataatgagatggttctaaggaggtaagacttaacctaaataagttttcgttcctttgaattagtggaataaatacatcttaaatttctccattccattaggacagatcacaggtgaacttggtgagggagtaagcgaagaacagttagagttgcagggtcctaaatcaaccacagggagaataatatattactctgcttattttactcttcctctcctcttcacgtttatgtcttcttcagtatttccttctcagtttgagttttatatagcatatgacatacacatatgtgccaacacaatgtgagtgacaagactggaagaggaaaagcttacattaatttatcttgaaaaatgaaatgtccaattatacaacattatagagtgctaatagctcaccaaataacataaataagattatatttcactcagtgccagacctgacaaccaaacctaggttccaaagtaagcctttctttttatcaatagattgaatatactagaggttaagaaaattcacataaggccgaatctcctctttaaaaaatcctttggcatttttcataaaaacagctctttgcccgtggctcaatttaggactttcacaaatcccttgaataatgaaggtcttggttttacatgactgtttatgtgtggtattctatgaaaggtccaaaagcttgttaaggacaattgctaaaaaaattaaaatatatcaagattatttttgtcaaaccaatatgtgttagaaagttatctattgaagtgtattccatatacttaatataatattattataataaatggcaagataaaaagaaatccactacaggatattcccatttctctccagagtcatggtatcaacagataacacgccagtctccccaggataccactataatttaatacatgcaaagtatccatctaatttacctgttactgatgaggaaattccaaaagtaagcttctcatcatagcaaatcctgaagaactagcatttaagctatttcattatggggtgaaaaaaatcatcatttagaaataaaagtaccaattagtaacaaattatgtacaagtcactctagcacagtgtatttcaatcacttcagtaatttttagcctcccaaaaaaaagtgtcagaaatgaggcatgaaaagctattaaatgaatcattcacacgttgaatagatgttgtcgtcagtttgttctctcaatggaaataatgaacaactgatttatttataactggtcattatgataatacaccttcatgttccacccttttcaatatattatggatatgttataactgtcttattttatagctgatctaaaatcatatgcttccattaaaatttcttcttttccaggctttcccttaattttaatgttcctttggcttggggtgtaattaaaatgtttttactgacttggttcccttgtcttttttttccttccaattttctgtctttttgcctggtggaatttatccatatcttaagtgtatgtaactagagtctgaaatatgaattttaagtagctgcagaatacatttatgtaatcactataaagtggatcttgtcagcacttatttagtcaagtttaccttgttttccttctgagataaaggtaagcagaatggataaagtaagataatggaagctgatttgtatttcagagaaaaaaattcttggtcttaagagtcaaggcaagaagacttcattcgtttttcattctttttttttttctaaatttcagagcagagaggaacatttcccttgaatgttccagttctaacactgtaattaattttgcagggttacattcaacaatttgtatgttttgctgcataacactctgtatatgcactggactctgccctcaatctgcactgcaggtttatataggaaaaagccttcagggattttcttctacatttaatcaaaactctttttgagaaatacatccatcacattatggaatatcattttttaaaaaaaaacatgtgagtaatgtacttcagagctaggtctggaaaaaagattcccttgggaaatggttatgcttcatccccagtgagtactagaggcctgtaacacaacctgtcttctctatacctttgctcagaaacccagaactgggttacattcgctatcatggtgaccatgttaagactcccatggagtgtcccagctttctcctttgtaaatactttttatatactttttctaatcctgttttgttaatcctatatcatatgtcttttgtaatatgttctctgaaattatttagagagaagtaaaaggtagaaatgaggaaataaaccagagatactattctttaaaagaattttttttatttttactgaaatggtggcattatcttaactttaggatgctaatttttttcttcctaacatcatgcccacgtaccattatctcatccctgactcatcttttaaaattttagttcctttatttgcaatttacatataagatgtgtggaaaaacccacagatacacactcacacagcacgccactcttctcatatgctgttgttcagacataaagatcactaagcaaaataggagataacatttcaagactttctccactaacagaaacatattctcaggtgatcggttagagtccaacaaggtttattttcaaaagagtcagcaagcgttagaaatgaatttctcaacaatttttgtttttaagagacagggccttattctgccacccaggctgcagtacagtggtatgataatagcttactaggctgggattggaggggcagacaggcagctcagaaaaagagatttaggctatcagagaaggtggaagaataaatgtttggatataattatcatggcttattatctacaaggtggaatttggctaactttgttaataaaacaaggtacaaatcatttaatgacaacctatagacttttagcttacatttagaaaatacttaaaaagaatttttccagcctgagcaacatagtgagatccccatttctacaaaaagttttttaaaaaattagctgggcatggtggtgcacacctgtagtcccagctactcaggaggctggggtgagaggatcactggagcccaggagtttgaggcttcagtgagctatgatcacaccaccgcacttcagtctgggtgacagggggagaactcaaaaaaaaaaattcaaaacagatattagatgcaagaaaagaaaaaaaattaatgtatatcaaaatattaaattctgttcccaattattatataattcctatatcaccaactttctttgaaaattaaagactgaatttgtaccaatgtactaattatatatctataattggtatatttaataagttaaaattttggaatataaggcctctacatttacattttaaaaatattcttagacaaggttctggattatatttcaattctgttcaaagagtaaaatggaaatgtaaaaacagagatgtctccttaacagagtgaaattaatttacaaatctaagcaatataaaaacatgagtaaaaatctaatttaattgaattattaatattaaagctagtccacacaaaatgtatttattctggagtctctgtagattttttttattgtttttcctgctgccatcaacttttgttatactataaatatggatgtaactgtacctacataactaccagcacacacctaaaattaaataagaaattttaatccagtagttcttaatttcttttctaatcctaagtacttaaagatataacacactattaataaatcaccatagtgatggttcttaaaggtgtgtgtgtgtgtgtgtgtgtgtgtgtgtgtgtgtagcatgtggggaaggtgtcctggagaggatacaaccttctgtgattttcctctgctaagaatcagccctgaagggtacaattcaattacctctttttttaaaaaaatctcagatcttggcttgggtctgaagcatgaatcatgtggagtttaatgcagctttgggtcaaccctgatcaagaagaccccaggaagagtgtgggaaaatttaaatttggataccccagaaatgggattatgtatctaagaatcctatatagcatgtcttgtcgtatgccatttgtgtcagctcagaacttccacagttctttcacaagctcagatcatatctcttggagccactttggtccctacacaccacagattccatctctgggctaatatttgactaacttcaagattatgtcaacactgtctatgcctcatgcaaaagcctcatggaagcaattaatctaacaacagtgcaaacaagacgactataatcacccaggtgatcatgaaaaagaacatgagggaaataaaaatgagatagacagattctggaagcatgctgtagatattatgtttttcagtaacagatttggggactgttgtggggttgggggaggggcgagggataccattaggagatatacctaatgctaaatgatgagttaatgggtgcagcacaccagcatggcacatgtatacatatgtaactaacctgcacagtgtgcacatgtaccctaaaacttaaagtataataataataaaaaaataaaataaaataaaataaaattgatgaacatgggtgctacatgatacaagtatcaaaggaatttcagacttgagtaattctgaagcccacaaaattagccacaggatttatcttttgttcttcatctactagaggaatggatgttacaaaccaatacaatgaaattaaaaataaaaataaaaataaataaacagatttacaccaaaacttttaaagaaatttgtgataggaaatggttaagagggtggggagagagggcaaaagttgggtcttcagatcctacaagcagaaaggggctctcttttaggtcagagctgatctttagttgttttgtaatgacatttcatctgacacttcctaggccaaatatttaaatagacacctctaaagaagtttagcaatttgatcctctctgcttgctcatttatattatttctttaagttacatttatgctcagtattcctatgcttcataggtatttgacaaaaaaatttaaagagttattttttctttctttgtttttttctttttctctagcttgctaaagaacaatcagccagatccaactagatgagtcaactattccccaggcataactcctggggtcatatcaattgcatttgcagcagtggtataataatttactataaatgtcttaaattacagcatttgaacacgtgccaggaaataatacttttccccaaagcagatgaatcatgaacctgaaatacataatgcacctcaaaggcatttaaaattcttctaaggagtgacttattcagatgatagaatgttgaccatttgatttgagtggtgaccttccaaaagcaatgaatagcatttcaatgattttcaaatgttattatcaaaaataaagtacgatagatatataaaataggtaaatatagaagcttctctagtaatgcctcccttgggaggtagggagcctgggaaccaacttcaataagaatcttggcttctctgcccttagtttttgtagaagggcccttctcatatgtagaattttgcctctccaaaatagctcagatatctgtgagggagtttggttgaatttgagagtctgagagcaagtgatattagataaagtttatataaaggctacagtcaacatcacagaacaactcagtttatttagaacagccagttgaaataaatctaaggatcgtagcacctaaccatctggaagtcagttttgaaaatatatatatatatatatatataatatataaaatatgctttatgattttgtttatgtgatttaagtagatctatgagataagtaaaataaaaattaaaaattctatagctttactttatatgtgtataaacacacatgtatatgcatatatattgttgagtctactaaacagtgtgcttctagatttattcatgcattcaataatatttattgagaacttactatcttcaagacactattagagatttaaaaaataaattagatatagctgatggtgtaaaagaggcttaaatgtgattcatctcaaaatcatcagaataaataagacagaaaattttaattactggtagtaagaaacaaagatgatgaaaacctaagccaggctgccatgaattgaacaacagagaaaaacagccctgggtctgatcagtttgaccttcagcaatgtcagctcacttctttgggattctgcttctttatctgaaaaataagggaaatttaaccatgtgatcttcagagtcccttctggctccaatatttaaaaaaaaaaacaactatactccataagtatgatttaaaccagaaggttcaaacctcattcttcacttgcgatagcttcgctgatgaataggaatgtcagccaacattccatctcctttccctttcctgttccagtttgatggaggtaccagctagcaataaaatagcattgaggagttgggactcacaaaaagaattgtatccaaaaccacaatactgtgactatggaattattgtttctttaccctaacatattaaaaatagctgatgaagaaaaacaatgaaaagaagactgtaaacaagtcgaatttcagaaaatacctgggagacaagtgtataaatattgtttgaaatttttttaaaaaatgaacattcaagtatttcattcagaattttttaaatgtgcaaattcaattataaagccatggtgatcacaagatacaaggtaaagttttattattaatttgaaatgtcttggtttgaaaaaagtttgatagtaaaatcaaggttaaatgaaatatcatgaagctgtgcaattaggttaataatgaggtgcctcagggatcagtgctagcacaggtgttcagtatatttattaatgacttagaagagttctgaataatatggaagcacatttggatgacttcatagatatttatagcaatcaaacgggtaaatgactgcttttcatgaccgattcaagagcaattatttaacacattacagcaaataatcaacaagagcaaattaatgtgaagtgggtggaattacccaagttttcttagcatgctaatagctaactgaaatagttattgcctttcagacaacagtgggcgcatctaagacatctgtccagtaaacagcactttaggaaaaaagcataatcaataaaggttggaataaagaataatgcaaaagaattatctaaatcaataattattgctgaaaatttctacacaccagagacttgctctactgaatggcactgttggaaaagagtgtggtttcccaaaccacatgctaggattatctggtgtcttagctggtgattttctaagtagttttccattatcatccattcctctccgatatccattcactggcattcccagatgcctctcaggcaggaataaaacttacaaggacatgcccttctcacttctgctttgctctgttctaaaggatttcattgatattaacttttatgttgaagatctcaaagctttggaaaaattaaaagtcatcccttttcacaagaaagatggcataacactattcaataatagcatgaactctattatatcctccccttatcccaaagttaattattgtgcatagaaagaaaacttaaatgtagcatcatttcagttataattcattcattccaaaatattttctgagtgcctattttatctaaagcacagtagtaatagaataaaaatgatattaataaaaatatttggagcctgccctaaaaacttagaaagccatgtctcccctctcatgaactaagcatttctcaatcctagtccatataaactacacataaatgtcatcaattatatcataatttgaaatatatgaaaattaataagaatcagaactgtttatgtagaaatatataataacatttttaaccaaagcatcattttccgctgccatttatcttttgtaccagagaaaatattatgaaccctgaggtaaattttctcatatgaaatataacttagatacttccccaaattttagagaaaaatacaatttctggactgtttgggactaagaaagtaggccaatataactggagtaaagccaaatactaatgaaaacatcaatgtgtgttcatattagctctacaaaataaccaaccagcaaatccactgacagaatgaagatatgtgtgaagtactgagagtgagaatttttctttttctttttttggaagatttggtaaagcatctctattctctatttatgtccacctgcaaatttcagatgtaaacatctagagtaatataccatgatcacataagaattcacagactttcagaatctcagtgttaaaaggaaactcagacgttaaccattgtttgagctatacatcttctctacatcactggacatactactaccggagataaaaaaaacatacacacaaaaactcattaattaaagccaaagacttgcagcgaaaagcaaattttcagcaattaagtaaacaatgaacctctgttagaacctcaaacatacttactaatgagatttaccagagggtctggaattatctatttaaaatataaaattacaacttggagaacaattcacttatcagaggtgtgacaattctgttaatttttctttctaaatcttttagtatctatgggtttttgtgcagtgtgatttaaatataattttagtaagggaaaacaagtagtgaatgagaattcattaacaggtggtcaaatgcaaagagtctatcaatcatgctggtatttttaaacatcagcaaatttaattccatctctgggggagtaaactcattctctaaggtatgtgacacatcgtatttatttttaaaggacatttcagagtgttccttgattatgaaatactgcaagtatttcctgccttaggtttcctaggcagacaaaaaggcaggcagaatccaccactgcaaatcagataattctaaaataaccaaatagtgtttctaaaaatgagaacatttccatatcttagctctagataaagagatttgtcatggtaaaaccaacaaatctgaatcagaccttaaactatgaaatagcacacaagagggatgcagaattttgtgctgaattacaaagagaagtcagatctgcaaatccacaatgacataataattaaataaatttaatcagcttttactgaattccagtttttaaatgtcaggcaattattatgaaatgactttttctacttgcataatccattgtgtattatatttctaccctgaatcaagtgaatgacttgttagtttgatcaaaaattatcactttatactacgagggaaagcaaccatcttatccaaactacatggcattagactgtataagcttcctttggtgaagcaagatatatatattgattttatcatacacatagactcttcaaggtcaaatagcaagttgaagggagaagaagtatcctgaatgaccattaatgctcttctataccatggcttcaaaatcttaaaatactttgcatttcacaagaagttatgtggcatttgaaaaccctctgaaatgaaaagaaatttctgatccccaaatggagtagtcaagaaaattgagcactttccagaaaataaaagactcaatatttcagggcaccctcctgcatgacaaggagagttacaaaagagaaaagccaacaaaaacatctcacctactgtatatatcttgtttattgcccattttcttgatgaatattataggaacatacagactgataagattcccttaccgtacaaagaaaagttatcctgttttgtaatgcgtaagtctttcctaaacacagagactgaattttggttgttattctactacgtggagaaagaactgatgttggtgaaggtgagttgcaatattgtaccattaacgtataaataaagcatgcccattgctggtagttatcccttcccaggtttcaaataggaactgggattttaaatatttcagaaataatttcttctaagtctctattgtcattgtatctctttcaattttaccacaccaatgatattcactgagcaagattccaaaacctttataaaagcattcccttgaataacaccttaaatcttactctgttctaaatttttaaactaataatagtttatctgaactctcccaactggtcaattctgtcataaagctacataaaaaccatcttccgtattgcagattatttttgaccaatcgatggatgaaattttggctattcttgttaacagtgtctcagtgtaagcattgttgtagttatcagctttgtaagaagtttatggaaatgacagaagctttggacatgtactcactgatagacaccagaataaatcatgaacaaaaccaatttgatagagaatcaagggagtcaaactgtaaatggtaatggcagattacccagtgcatgggtgagacaatggcatccaaagagatggttagcctctatatacctcctccatagaccatgtaatctgaaactcctagccgttagattcattcctctaagataatggctgcaagataaactactttagttgaaagtatcatgtttggaacacactattgagtagtataggataactttcagtgccccgcagtgctggccacagtacacgtaagttccaaaaaatcattcacaacctcaagtgttcagagggtcaagcaagtactgggcatgaaaaaataaacaggcaagtgctaatgtcaattgaccagcagcctcaatgtctgcaaaacaatagagagcagtgtaaactgaggtaagcccttgtcccatctaaaagggacaactaccactgatctccagagaactgttgccaaacagggatataggtccatatcttccaggttttctagagaggtaaaaaatctgaattttttatgtgaaatctctaattttcaaatgttagaaactaatttaattgtgtagcacgctcttagccaacattattctgagcaaaaaaaaaaaaaaaaaaaaaaaaaaagctgagggccagatttggccaacttgttggcaatttcctagaatgccagtcaaggacgtgaagaagggagattcagttgggatgaggatgagttctagactgtcaattaagagaccaggtaagggctatagatagcgtctttcctaagggaaaggataagcaagcagactctacatatgaaaacctaaatgcagtaagccacttgttatgaatagtacattttaagaaaatgtacattattcatttttttaaaaaaaggtctttttaattattttattttctaactttgtctttaccctttgtccaaaaaaagatttacaataacataacaaagtcttcaatagaataaaagtaaaaataaattatgaaagacctagaagaaatgatgttagtaatagtaacctaaagtacaccaaatgcacgctgaatacagtcaaaagaacaaaaatctcattagccattaatttataaaatggattattatctgcatggggcgggggaagatgtgtccatttgcaaagtctattttcttttttaaaacatacaatttggtctgtggtgtggatgaatctatcttgttcataactaatacagtaacaaatgctgcatatcaaaacaaaggagcattattacttattttgactctctagattatttgtttccagatttaaaaagcattaagggatgtctttgtgagccaaaatagagggcagaacagatcccttcctacttaggattttaatactcccttgcctgaaagggaaagatttttcaataataagaaaaggcaatgtgagttacaggagcatcggtctgatgaggccatatacaggatatcttaccatcaatattcctacctaatgtgtcagaattgtacagctcttttttaaaaagccacattaataaaaataagcacttctaccaagacaaattgattgttgtttgttgttactctaaaggaaaggaaaaaaatagggctgcagcagtatcagcaggtaggtattagtgtattctagtctaatttcaaccccaaatccatactattaaatacaatttggaaaggctcagctgttagaggatcagagtatgtgcagcccatatgtaatgaagaaacactcctgtaaatcagtgaatgagcaccatgcattctgatgaaccaagtatagaggctgaaattttaagtaggcaaaaagctttctctccttacccagcattcctgaataaaactgataagctacagccctagagaccaggtctctgcatttaatttgtttaacaaatatttattgagtatctgcttgatgtatgctagtcctggaaaaaaattattccaatgaacggccagttaattcatgccaactaaatagtatctattctatgtgcatagctacaaaaatagcagagtcaattcaccactgcagcataatacaattacaataacagctctagtttattaacaccattatttaattttattttgtcttataacaaaaaactttttactttaaatcattaacagccacaacaaaatgctgccagatatctgaacacattttctttaacccatctacactactaaacctaaaattgtacacaataaaattccaccttgaagtaacaaccttggagcattgcaaaatgttcaattataaaagataaagtaaattttcatagaatggtgtacttactgagaaagaaaagcatcacacatacatcaaaaagatcttcaatgtcaaagaaagaaatcaaaaattttggtccttgtaatcttgaattaatcagataatgtaatgcattagaatgctttcttctttctactccagtatttcaaccaagtaggttatactgtttccaatactacaaatatgctatcttaagggtactaaacacagccctgaggacaaggagagaaaaactagaatctagcatcaaatcttctgtcaattacacatatacacatacacacacgtgtggacataaagtgtaaacttcagactagcctcacctgaaaattagttagaaatccaaattctgaggccccagcccaggaactctaagggtggggcccagaaatctgtgtttctacataaaggggattctgatgcatgctgaaaatagaaaatcattgctccaaaaataagaaatgatactataaaatgttcagacctctcaattccaaaattgacataatgtttcaaattttaaaaatatgaaatgctactcaagctcatagctgttacttatacttaattatgattaatgggagccagtcttctcgcttcctctagttctctctctcctcctgcgtgtaggggtgtgttagcggtgtgtgtgtgtgtgtgtgtgtgtgtgtgtgtgtgtgtgtggtctataaatgactgtggaaggttctatgtaaacactctttactcccaatcataaacaaatctatatggaaaatattacaaaaaatcaatttctagattacatttgtcacatggagaataaccaatttctagtcacttgtcatgggtgcataacctattaccagaactgattcacggtgaattgactagctatgtcaaaaggaagatctgcagtctacagagaaataatccatttagtgttcgaaattttacagtaaaggctgccaaaataacagaatttattacatatttttacaggtatattaagctataataaattcgtcattcctaaatcaagataattcatttatagcctattcaaaacttacttaaattaatcatgaaacattaaatgcaaaatgtttttttcttcacataatgtcacaaagtgacatgaactaatttgccaacatgttttcacagtattgttattctgacatatactaacatactaaccaaagattatcaccaataatgttggcattcatggctaaaggggcagtaataattttatatctacaaggactgaattaggcctctcagacaggaggcttgggaaaaatcatttttcaagttaagccaggtgagtctgtaatcaatgaccagagctctgctggaactgcagtgcctcgaaggaatcaagttaagttatgagctacagaagaaaatattgattcttgcttttacctgtttgtttcacaaactagaatagaaataaatattactaattttatgttgtaaatatttaatacgttttttcaatagtcactatagaatatgtaaggaaaccaaaacaaccacagttgaaagtcctatgacattagcaaagctcaggaacttggcattttcccagtgatgatgaataaaattaaaatactgatttcagtgacctgagtgtgactgtcatttgtctaaaatatacttattataatgtagtaagaatgcgcccgggaaaatacgttattcccccaaatctcattttttaaaaaattcattttataaaaaaatgaatcattagcaattgatgttctttccaaatattttagtgcccctaaagcctaaaagtgtatcctagaataaatttataccattcctcaaacttacatctatgaatattaaacatttattgcttgactataaaacttttctccagactatgtcagtatctccacttataaaaaattagggaaagattaaccaaatagaactgaagagaatagaatctacagtggggttgtaccgtaaacgcatataacttacacaacttcaattatgtaagttgagaagaaagcaataatgccaaagattggtctgccaatttgtatggcctggacagagtgtgaaatgggaagtgttaatccaccatgccctcataagcacaagtagccctgttgagggtgattatgatatttaaaggtatgtcttgtcatatatcacaacccttgaaaaaaagtcaagtatttctgatgctcaactagaaaaaactggctattgaacttactgagacatagtatattgatccccaatatgccctttttaagagtactttatgcttggtttttcacgttctgttaattctggaatctaacctctgaatacagtgcaatgttttcctgtggatcaatcatatcatgaaatgcctttcacagcaaagaaaaacaaaagtgtctttcagcataaaagacattgtggaaaagagaagaaatactaattttattatgtatctttcatgagaggtttcaggacagcttaaaatagtaaggaatctctgacatagcttcagaatgatagacaaacaagacagataaaattatttataagaatacaaaattaggccaggcgtggtggctcacgcctgtaatcccagcactttgggaggccaaggtgggtggatcatgaggtaaggagttcaagaccagcctggccaacatggtgaaaccctgtctctactaaaaatacaaaagtcagctgggcgtggcggcgcgtgcctgtaatcccagctactcgggagactgaggcgggagaatcgcttgatcccgggaggcggagccaagattgtgccattgcacttggcttgcagcgagccaagattgtgccattgcactccagcctgggcaacagagcgacagagcaagactctgtctcaagaaaaagaaaaagaatacaaaattataattgttactcagattccatctcaaagaaaatcttcatgccagcactttcttcaatatatctcagccacaaggcaaatatatgctgactaaactctactttcaaagtgtggttaagagataggtggtggttgagaaacctcctaaaaagatccatatacattggggtgaattcatctttgtccaaaaatgtaaccgttgtaccaaatgtaacctaatgtaacaatgagacactctgagccttgctggatggtttaactagacaggtgttctgggaagccacataatgacaaccaagtaaatgaggaaccaaactatgcactgtttgggagttttcagattttgtttttgtttttttcttctgttagggagcagaaccctctctaacagaattcttcactgaattccatcaaaccttttaatacagctacagcatatattttctgcctgacaactcaagtgagtaaacactaaacactcatttctatgtatttctttatttcctcatgaagaaataattattttcccgctttattttgatgtattttgtacatttgtatttagattttaacccatgtaaataaacatttatgatacaaccccactgtagattctatcctatctagttctatttggttactctttccctaattttttataagtggagagatactgacatagtctggagaattattgacttattatacacttcatttttaaagctaatgaaaacaataataattcagtacataaataataaaaggagttccaaagtttgtgcttcataggagaaagaccattctcaagccctactaatcaccttcacttacataaaatgaacatcatcattccaggatttaagctacatgtcccaagtcttctttccttctctagcactgacctcgcattaagatgattgagagtggaatatccattctttccaggaaaagatgaccctataatcagagatgtggtttgatcttctgcaatgccagcaaaacaatcagacttcatatcactccccaacatctgagtcataacattgagaatataacaaaaataacattgtgtgggaagtaccgagattcctgtctaggtacatctgtaccaggtacagtcaagctccttttcagtctctccttaggacctaatctcaccctcactcattttttacattatatctgtaacaagtaataaacatttcttctacactctgacttagagttattattcaaacttggtaggaaagaacttgagattgtgatcagagactttataattctgtgtgtgtgtctgtgtgtgtgtgtgcatgtgcgtgcacatgtacatgcatgtgtatcaaaaagagcttgggtttaatcgttcacattaattaccccacatctttactacccatgtttttcctcacatgtcctcaacttagcaaatgacactaaccaatagctcaaggtcaaaactctggagtcattcttgactcctcctcttcatcatctcctatatctaattaatgttcaagttttataaaattcacatttaaccttgtgatggttaattttatgtgtcaacttgactggccatagggtgcccagatactcagtcaaatattattctgggtgtttctgtgaagacattttagataagattaacatttaaagttatagactgagtaaagcagactcagtttataattttaaatgttaatcttatctaaaaaagattattccaaaaggatgtatggtttttctaaaatcagtccttcatagaaagcccaattctatttctacttttaaaagtaatttatttaatttctacatctctcaactgggaaacaataattccaaaataatctgatccttttttttttaaagaataaccatgaaatattcttccccaggttaacaaaactagtagcccacctgcaatattctcgatcacaagcactttgcaggctgcactatacagagctacttgggtagaaatattttccttttgttcctttaacagctttacccctttgacaagattttaaaacaatcaagtttaatttttccaatttcttcctcagtattactttggcaaaggtttgggcattaagtgaggtagaaatcaataattctccaagtaatgcttgccccagaaggtgtccacatgaaaataaataggtgtcctgagcataaaatattttttataaatacctatttgagggaaacaaaaatcttaatgcctcaagtatttaagactttttaaaaagtaaaagaaaaaaatacaattcctcatttaatggtggaataactacatctagtaagatttttttccttttccttctaaacatagaaaattaatacaagttgaaactaggctaatcatgaaaaagtgtaaattaaaaatgtacattaatttaaaaattcttctgaccacatgaattataaaagactgcaaatataagggaggaaaaaagaactgtgaaaattagactgctcactcatttgaaaccctttgataaaaagcactctatcttcttcggactgccacccctgtgagggaagggactgtgacattttgtattaatctctacatagcacttgcctctgtactatgcctgtgacagtatttcataataaaaaattttcagattttttcagtggaaccatgttcattaaataagaaactaacaagatgtgtttgtcatcccaattgccttggaacattaaccatttcatttcaaatgttaccactttgcttgctaaatttacttattcctctaagtttaaaagtatctcaaatcctgaaatgactttataatttagctgttaattttctctagccacttgcttttaagttaacaacaattctgacactatagcttattaaccacaaacagttatgaattaaatcaagtataatgtgcaattaaaactcagatgcagagtcaaataggatttccccacgtctacataagaagctttgaaatgcatacaataatgacacatgaatcattactattatagagatgagaaaaatgttgaatactaggattttacaatcaaacgagcacttgttatttactagatagtaaatttcaccatttacgtttctttacttccttatgccctgtatgaaaacacaatagaaacgaaagtgctaagtgaagtctttcagtattttaagaagtagaaaaccttggttgagacctcactccattcaaacatttagcaaacatccactgatcacaatctgtagtcaatcactgtgctactgaaatatgtggccaccatgattgtgacagttaaggaaccatctgtaaagaatgattcttgcctggtatttctcacttattctgaaaaataaatcttgactagaagagagttatctaggatccatatagaagcatacttagatattttctgatatataaaatgaaaaagagaatgtcttgcaaagaacagaaattaaaagcacatgaaggacactgtctttgaaatctaccccccttccaacatcatgcttgttcaagcacccatcaccattcctttaaagaaaccctcctttaaagaaacctcaggagggttcctgcctcagtgttgctcctctatgaacctccttccactactaagagtgccatctttctaaaacctgaccagaacatcacggtgccttaagccctcagtgtctctttcccatcaactagatgaaatccagtctccttggtttgtatgatgaggctctttgtgatctagatccacttatagggcaggcagggagaagccaccctctatgagggaggtgaggaaagagtaacccataacttttgctatctcaaaaggttgctgaccctaacaccatttaggcaaagctggtcaatggggagatattggatagactcacattagaagtcactctgagaaattactaagactccagatcataattcccaaaatttaaaattagataaaccttctgaaatggacctgtgacagataagagtgtaaatctgaagaaatatactcaatacaagggcctaacgatttgttgaagagatcttttcaatacattgtgtagcttatgttggaagcctttctaaattaatacattttagcatagttatgttgagcatggaaatgggaactagaacggtttataatcctgtgatctgagcttggagcatcaatgggtcctggcctggaacctgtcccacagcagaagatgaggacctggtagacgatatccaacacagcactacatacaaatggaagcactgacagtaatacagacattggataccctttcttcctctgcttgaattgcattaacttctggcattttggacaggcatcaagaaggtaagtcattcaagaaggtgaggaaatgaatcaaggatggcacaaagataaatatagggcatgcagagtctagagtaattgattcaaaaaattaaagaaacttggctccattttttaccttatcctgcttatacttgcaatacctctgggcattatttttcactcttcttcccttcctactttacgcttaccaactcagaactcagaatacactatgctctcccatgtctcctcgttatgctctttcctttgcctagaatgctctaggaagccttttctgagccaagagggttgggttaggtacctttctttggtgtttccattgtattctgaggatgtgtttatatgatacaatttattcaagcagcttatcctctatatgcctctatttcacttgtaaaatggagacaataatagcatatactccataggattgttttggttatcaagcaaggtaatatatgtgaaaccatttaaacaatatctggcacaaataaacaactatataagtaatagctattgtgttattattattattaaaacacattatgcttttatcaggtactatgtggcagtcattatgccgggtgttggtagaccattggtgaacaaaggaggcttggttcccactgcagtgatgctatataaaattactcattcttcagtatgtgtctccatgcctcccagtgtcagagatcaatctttgtcattttttgtgtgttatcagcacctagaagaggatttatcacagagctgggcatataagaggtgctcaaaaattatttaaaaataaccccagaaagtcctgagcagaggaaaaaaacatgtggcttgtagacatgcaacagcattaaactcactgaaattatgtgtggctgggacccaggttaaatgagaataagtgaaagaaaatgcagctgaagagaaggaagcctagatcacagtgggcctaatactatgagaaagagtttaacttagaatgggaattcagaaagcattttaagtaaggagtatcatactcatatttccattacagaaagaatggaaactgtgaaggccaatgattggaagaaactgagactagaggtagaaaataggatggtatttgcagtattctgcataagatgtgatgaaaatgtgatctaagatagcatcagtgtgaatagacagacaaggatagagcaaaattaagacaataggtctgataggccaataggatacagcatttgaagaaaagacagaaatctaatatgactcttatgtttctagcttgggtgctaaatacattgcaaagcattaagtgagatgataatatgagaataaggttaggattgatgcgacaaaatggagatcaactgctgaattttaggcatatggaggcatctatgagattaagtagaaatctaagagtcggtaggttatatgcacttaggtatcaagaaagaaaatggaaagtggtctttgctggacaactataaaacctggtgtaaattaagagatcgtgtttccagggagatgaaagagaaagttaatcatggattaaaaagtatatgtagatgtacaagaaatcgaggagatgtacaagaattgacgatcctttctagtaatattttagtcaagattatcaactcaaagtaaatgagagggatatgggttacgaattgaggtggttagtgaaggtttgagagaaatggaaaagaaggttatcaaggacacataaaatatattaggcaaggaaccaacctaagtgtccatcaacagacgaatggataaaaaaaatgtcgtatatatacacaatggaatattattcagccataaaggaaaatcatgtcattcacagtaacatgtatggaacttgaggtcattatgttaagtgaaataagccaggcacagaaagacaaatgccacacgttcccactcatatgtgagagctaaaaaacttgatctcagggacatagaaaaaaggaccatagataccagagactgggacgggtgagtgggggtgagggggtatgaagagaggttggttgtgggcacacacatacagttagatagaaaaaatatgttctaatatttgatagcagactacagtgactatacttaacaacaatattatgtatattttaaagtaactagaagagaggacttgaaatgataccaacacataaaaatgataaacactcaggtgatggagacctcaaataccctaacttgatcatgacacattttatgaatgtagcaaaaactcatatgtactccgtaaataggtgaaacattgtatgtcaataaaagagaaaaaattaaaaagcaaggaaaggatatatatatgcttgatacctaaatgcatagtgttctatagccttagctagagcatattgcctgatatatatatatatatatttatacacacacacacacaatggtagatacatacatacatacatatatatatatacacacacacacacacacacacacaatggtagatatatatatagcaacaatagtagagaaacacagaaggtaaatggttggactgatttaaagctgaagctttacaaagtcgtggtgaagaaatacaaaggagcaaaggaatggagggagctgcatgcctagggagcatccattgctgagaattatgccacatagagaaaaaatgtagttagaagaagggattaacaggcttaagggaaaaaaatgaaagaatcaggagattaaaactctaattaatttgaagagtaaatgcagcagatcaactcaaagaataagaaggtacgtcttggagtttaagatttcagagactgaaaattctaatacatggaaaagacctaacatgtaaccatatgaaggagagctgaaacttgcatttttgagcatctgtaggcattgtgcttggcattttacatatgccatctcatttgataatgattttctttatttagagagacaaggtcttgctatattgcccagaccggtctcaaactactggactcaagtgatactcttgcctcaaccttctgagttgctgagattacaggtgtgagccactacactcagcttgattcattatttttatagatgaaaagactaagtatgagtcaagttacatgatttgcccaatgttacacagttagtcagtagccgaactgggatataaactctagcctgtgtaattccaaagcatatactctttctagaataacacaccaactgctcaatgtgagaaggttgtcagggaaaaatggagcaaagattacttgaagtaagtaaattaaagaattctgagactagatggtggatggggtgattcaggtagacacagaagtcattcacctgacagctaaacttgaatggaacaatctattagttaattccataatcattgaaaaatgtagagaagtgataacgagactgataaatggagtatcccatgatgagctctgctacaggttggcaccatgatgggtgaagaacacaaaaaaaggaatgtatattactgcagcatatcatgaatgaatttcctaataaaataatacgatggatgctagagattttatggggccactctcacaaaccctctcattaaaagccaagttctgggaaactggagctggtggattcctcaattcctgcttgttacattgaccctgaactttgagcacccatcaagagagcaaggagactggaaatctgcatccattcagttttattaagcttgtatcctagatatctgcatccattcagttttatctagcttggatcctagcttgcactctttgtttgctagtttagtgataggacaaattaaaagcaactttaaactaaggctgagtcatcatcctacagtcttctaacctctaataactgctgaggagtggttagttcaggatatgggatatccagaagttatgagttccaaagaaggagggatttttatatgacagagaggagtcactctgtagacacagaagtaaaaggcaaggtgagtgattgcccactaccaccgctgagacccatgattcctagaaggtgggaacataggcagacaccattccatatggtggcaggatagagctatcttttaattaatagaaaaaagatagaggggtaatgttccttaaggtgttctggtttgttttcaagttgatatggttctggagaattatgggaagggttgggagatgaaaaacaaagggaggaaatatctagagatacagagaatgaaatagtataatgataagttcattaatgaatatgggtgactcctggagcttgtattttgttaggttgacacagatggcagggaataaaagaatggtggtactaatttcatgtgtttccttgtatctctgacataacaaaaatatagtctttcagctgagcataatccccgcttcacaatgagagtaaatcttttgtgtcacaacagacctgaccagatatatgcagtaacaacaatggacatacaggtaagtcacaatggctcatgcctgcaatcccagtactttgggagaccaaggttgaaaggattgtttcaaggccagcctgggcaaaacagtgagacctcatctctactaaaaaattaaaataaaataaaataattaaaggggtatggtggtacatgcctgtagtcccagctactcaggaggctgaggcaggaggattacttgagcccaggaattcaaggttgcagtgaactatgattgcaccactgcactccagcctggatgacagagtgagatcatgtgtcaaaaaaacaaaaacaaaaaaaccaatggatgtacatgttttggaagggtaagatgatcatatatgccctccacataccaacaccaaaagcattgatttaaatctcacactagtctcaatctcacaaatatctcagttttccttataaataataaaaaaattaactcattcaaatttcttttgacccaattatatgtttctactttactatgtatttgcataacaagtttcaagaaccacttaagaagcaaagcagtttatctttcttcttgaatcatgaatgcctcttttaaagttcacataatggttatagaatattctagtattcataaacaagatttggagaacaaggtcattttaacttttcctttattttttatttagccttcaatcatattcctttgaagcttttaacttttatgctaaacaacactgctgttctgatttgagagggtattttttgtttggttatctgttcatctgggtttttttgtttggttggtttttttaccagtcattacatattccattatcccttatattttctatttttagggtaatttctattttccttataccactattatataattatattctctcatatggtataaagatttatgtgtgtgcttccaaagctataaatcctaaaaagcagagagtgttgctgctacctttatttattccgctttcaggaaataaacaatagttacactatatttttaattaaatttctatgtaattagaatttttagaaagttaatttctccttagaaagtaaatttccaaaggagaagcaggtaaacgatagtgcacacaagagaaaataaaagaatgattgcaatattctaattacaagaacactagaaaaagagaaagagagaaggagagagagagagacacagagagagaagtttgcattttctatctcccaccagcttctggccatattttcaactagtattcctacattaaacaaaatcaaggaaaaatactctagaaaagtctttcaatttgaaggtaacataagcttcctccaactatactgaacttcctcaaaaaagaaacttgaatctatgaacccagcacaagaaatcttgccagggtgagaatatagaaagaaatcatcctagcagggggaaggaagagtaaaagccaaattgccttaagtatttggatgtaaataccaaaattacagggacaacatctctcattcagagaagaaagaagagaagatgatgagtattagttcatttttagttgagagagtagggggcatataaaaaggaccaggcaagaagtgactccaacctaaactccaacatcagagtagaaacagtcttcccaccatttcgtacttgctcctctgggtagctgtggctgaagatcaagggttggatgaggagaggcaggaggacagacccgaaacattcagaaagacagatgcccaggtcaacaggcctacagcagtaacagtaagtgttgcatgaatggcatttggcagagatgatcgctctgagggttaccacaagtctacagatagatggaaaagtatgttagctattgtaataaaagtttatatattgtttatatattgtttttgtcataagaaaatgattttgttgcattttctgtattaaaaaaatatcaaacatcttggattgctcttacacagttccgcaaatagattgagcctatcatgttttaattttgttaattttagtaatcttaactattaacctttacacttggaagcatgatttgtcatctaacaaagtgttttcctatagttactcaatttcatatcagaggcacaagataaggttgagaaattctgctcctatatatgcaagtcagaaaaagttttagttttgtaacaaatcatagcacaaaacccatttgaccctagccacctcaaaattgtctcattctcacaaccaattttgaagacacacatacatcttttctctccacataatgttcctttgtcatagccactgaatagcatgaactaacagcggtcctgaaattgtgtaggcttggtaaagccacctgcagaggaataaatatgtttaattaaatccttttaaaaaaagagtttaaacagtattattccatcttccaccctagccctgccaatgtagtgattatatgtctattaaaaaggagggcttgtatgagttatcatgacatgcatcactagattgtagataatagaatttagtatgtaatttattttatatatttatttaaatatataataaaatataatcccagaatacaaggtcctaaggttcaagcttatgcacaaaattgtgtcctttcttgggatatgccatcctccaggcatggacatttgcttacaaaataaatattgtatattataacaggaagagacttcaaaattcatgattgtttattttttccctttcagatgcacctccaagaagaaacattagatttatatatgtatgggtgtgagtgtgtgtgtgtgaaatctggaatggaagtaaaactgttaaaatccatgagaagtcttgaattaatgaagattcagaattaggaaacacagtacacatgtcccataaacaaagaagccagcagtggaccccttcaggtagtcatcaaagaacaacataagtggatatcagaaataaactttcccaggatttaacaaaaataacatttctcatttataaatcatactgttcagtagatcataatctgtagcaaactaaataagtagatccctgtcctctgaaacagaattgaaactgctgcctgagcatctaacttatctatactgctctatcaaatatttcttaatcagttttagcatttgtttattttctctcttctgaaacaatggctaataagtgcccagcactgtccctgacacaactcacatacgtgctcattaaaataaagctatttaaagtagacattgtcttgtcgtacagcactcctcttctaaaaattattcctttcaaccagagggttcaaatggcagctgccagcttctcagatgatttgcccataaatgagcacccaacccaactttctgggttttttgaaaaaaaatagtggccttattgttattgttttgtatgtatatcttagtgtccaccagcatccatgcattttcctctgtgggatatcctagagattttacagaaattaaatttcctaagtcatccatctataggggtagggacagtggacagggcactttaaaattatttttcttggaaaacagaaatgagcacggatcttagaaagctcttatatatttagcagatgtaaatctgtttaatataaatacaaaataaaatcatactcttaaagattttcaggtacaataaaaaagctacagtgtgaaaataaaagatacatatgtgatttttaaatttgacattatactttttcacaatatttcaaattcagattaaaacatttaattgattttatttatttattgtgatggagtctcgctctgtcgcccagactggagtgcagtggtgtgatctcagctcactgcaacctccgcctcccaggttcaagtgcttctcctgcttcagcctcccgaatagctaggactacaggcacatgccaccacgcccggctaatttttttttttttttttttttgtatttgtagtacagacagggtttcactgtgttagccaggatggtctcgctttcctgacctcatgatccgctcgcctcagcctcccaaagtgctgggaccacaggcacgagccaccatacccggcctatttttattttttaagatggagttttaagatggagttactgcaacctctccccttcccggattcaagcaattctcctgcctcagcctcctgagtagctgggattacaggtgaccaccaccacacccagctaatttttgtatttttagtagagacagggtttcaccctgttaacctggctggtctcgaactcctggcctcaggtgatttgcccgcctcagcctcccaaagtgctggaattacaggtgtgagccactgcgcccaacctaaaaaatgtaatagatttaaaagccaaatataaatccatagtttagtgaatattgaaataaggctataaataattttataatcagtgtgtttataaaacagcgtatcattatggtacagaatttaaaagttcagaaaaaaatgtaatgcttaaacttttgtcccaatagaaagcttccattaactcaaagggaaatctctgagaagtattaatgtttcctaatgaacattatggaatttctaagcctacattagacacttgcaactttgatctgtctatagagtgctttaattcttcaagcaattttttagaagtctccaagtgaaaatatattaggaaaatctcttactaaagaaatgcagtaggattgatgggatgttttatttcttacctttgaaaacatcccttatttctagcctaatatatacagacaacacatatctacatttattcattcaaattgctattgaaatagccataaaaagaaaatatcttaaaattggtaagtcatcacttctttataagatggttttatttgtaggtcaattttataaaattctctttttgagtgttatggttaataacatatttaaagatttaaatccatctgagagtttaaacaaattgccactatttatgattattttgtattagaatagcaaaatgggctgcattaatagtccagctctaacacagaagaagcattcgatttatattaataattacatataactggtttataaattatttgcatacatcccagatatatatacatgactgaaatttaaaataatttttttaaaaataaaaagacttctgaacccagatctactaattacatgtacaaagagagatgccctataagttggaagaaaaacaagtataatttaaaagacagctaaaatgtatgaaaagcaaacacgtttatttttaaacttcaatatggcccaataacaaagactgtgatattagtgaaaatggtaaaacaaagtcctttttggtactataaatactaatattctaaggacaggtcaagtcctatttggttttatgtgccacgtgaagggggaaataccagttcttttgttattccttttcctggtgagagagggccttcaaacggccaccacagtagcctgcatgaacagtgctttcttacaagacagcattgctacattacattgcatctttaggcctatttaatgggtgaggtgttgatcatatgccaagaaagacataaagagaatgaggaatgtacatagaaatgctattaaaatgatcccatgcttgagaagagaatcaagagctaagaaattaagaaaaacagtttctgctttgaaggagcttaaaataggacatcacctcaatgtagaggcatgctcccttgccgtctcaaagataatatttggtgatcagagccagaaaaaggaatctaaactacttgtttttgtagttagctctgtcatttaaccatagtctaattatccagctctatatattaccataaaaaaatctttaaatgtacaccatgtaacaacacttatcaacctaagaggaatgccaattaatgcttgcaaaggcactctaagattttttttttacaagcaagtgctatataacaacaaaatatctattactattctatctttccaaccaaagcaagttttgtcctcctaggattgctgggagcaaaataaacccgacgtcattctcctaagcccaattggcagcccagctgtgccattatccccgggaagtgtggtcatgtacggtaatacccgcattatgtgacaatgaccaagtcaaaattacccccttggaatagagttcagcctctgaaaatgtagaactgagaagacatgctgggttcaacagagtagccatagtgagggccatttttgtttgataatggccctaaattactgatatcaacttggcgtctaagactcagggcaaaagcagctattttctttctatggaacattcaccaaaaatataaatgcagctgccttagtcttgattttcttccctgtttttatgggatatataaggtcacgactataaatatagataaaatttatataaaacaccaaattaactggaaagcattttatatattctaaaatatatccagggtgtttttttttcttatttatagattttagaggcacataaaacctaggccccaagccaatttacagtttaataaacagctgcatagttgtgaattttctggtataaaatataccaaaatgataagaggctggtaattcagtgcattacctacagcaatagcttgatgcaatttttccatatgcttgatttataaaaacaaactcattttctggaaatggaagattaatcttcttcaacaaaattttctttatgaaaatgaaaaaaagtgttttctataccaagaaaaaataacatatattaggacgtagtcgggggcaggtgagaggaaaaaaaagagatattattggagaacaaaaactatatccataatccctttctcagataactgcttattgacttttttagaaagtagaacatagtcaaggttagtaaaaggtatattctcttctcctccacagttctgtctccctgggtttccttccaaaaaaaaaatttttttaatgtgtattagtacatactcacatgaaaaatacatgtgtgtatatatcaacttttgttttttcctattacaatgagtgaacctgctgggttaaaaaatacaggcattcctcagagatactgcaggtttcgtatcagaccatcacaataaagcaaatatcacaataaagcaagtcacatggatttttttggtttcccagtgcatgtaaaaattacatttactctatattactgtagcctattaagtgtgcggagcattatgctaaaaaaaatgtacgtaccttattttaaaaatattgctaaaggctgggcgcagtggctcacacctgtaatcccagcactttgggaggccgaggcgagtggatcacaaggtcaggagatcaagaccatcttggccaacacggtgaaaccccgcctctagtaagatacaaaaaattagccaggcgtggtggcatgtgcctgtaatcccagttacttgggaggctgaggcaggggaatcgcttgaacccgggaggcagaggttgtagtaagctgagatcgtgccactgcactccagcctggagacagagcaagactctgtctcaaatgtatatgtatctctctctacaaaatgctaaaaatcatctgagcctttagtgagttgaaatctttttgatggtggcggttcttgccttgatgttaatggttgctgactgaccaggatggtggttgctgaaggttaggggtggctgtggcaatttttgaaaatgaaacaacaatggagtttgctgcatcgattgactctttctttcacaaaagatttatctgggccaggcgcggtggctcatgcctgtaatcccagcactttgagtcaaaggccaaggcaggtggatcacctgaggtcaggagttcaaaaccagccttgccaacatggcaaaacaccatctaagccaagcgtggtggcgggcgactgtaatcccagctactcgagaggctgggacagaagaattgtttgaacccagaaggtggaggttgtagtgagccgaaatcacgccactcactacactccagcctgggtgactgagcaaggctctgtcttaaaaaaaaaaaaaaaaaaaaaattatctgtagtatgtgaggctgtttgacagtgtttcactcacagtagcacttctttcaaaattgtagtcaatcctctcaaaccctgccactgttttttcaactaagtttatggaatattctaaatcctttgttgtcatttaaccatgttcacagcatcttcactgggaatagagttcatctcaagaaaccactttctcatccatagaagccacttctaatccacgataactacgtcatgaaaatgcagcaatttggtcccatcttcaggctccatttctaactcagttatcttgctattcctcccctgctttaatttgtggtatcttcctccactgaagtcttgaaaccctcaaagtaactcatgagggttggaatcaacttcttccaaactcctgataatgttgatattttgacctccttccatgaatcacaaatgttcttagtggcatcaaaaatggtgaattatttccaaaagattttcaatttactttgcccagatctatcagaggaatcaccatctacagcgagtatcgccttacaaaatgtatttcttaaaaaataagacttgaaacttggaattattccttgacccatgggctatagaatggatgttgtgttagaaagcatgaaaactccatttatttctttgtgcatctccatcagagctcttgggtgaccaggtgcattgtcaatgagcaatattttgaaaggaatcttttgttctgagcaggtttcaacgttgggtttaaaatatttagtacaacatgcagtaaacagacacgctgccatctaggctttgttgtttcatttatagaggacagtgtgggtttagcataattcaagggccccagaattttcagaagagttaatgagcattggtttcaagttaaagtcaccagctacattagcatctaacaaaagagttagcctgtcctttggagctttgataggcattgacttctcctctctagttatgaaagtcctagatgacatcttcttccaacagaagactgttttatctacattgaaaatctgtagtttagtgtagccaccttcatcaatgatcttatctacatcttctaaataacttactacagcttttacatcagtacttgctggtttaccctacacttttatgttatagagctgacttatttccttacatgaaacaaacactgctggcttcagacttttcttgggcagcttccttatctctctcagtcttcacaaaattgaagagggttaggttctttctctggattaggctttgtggctggtttgatcttctatccagaccactaaaaccttacatcagcaataaagctgttttgttttttaatcatttgcatgttcactggaatagcacttttaatttctttcaagaacttttcctttgcattcacaaattagctagctttttggtataagaggcctagtttttggcctgcgtaagctttcaacatgccttcctaactaagcttaagcatttctagcttttgatttaaagagacgtgcggctcttcctttcattgaatacttagagggcactgtagggttattacttggcctaatttcaatattgttgtttcacagggaataagcaggcccaaggagaaggagaaagctggaggaatggctgttctctggagcagtcagaacacacacaacatttatcaattaagtttactgtcccccatgggcatgttccatggtgcgccaaaataattacaataataacatcagagatcactggtcacagaacaccttaacatatataatactaataaaggttaaaatattctgataattgccaaagcgtaacacagaaacatgaaatgagtacatgctgtcagaaaaatggcactggcagactttttccctattcctgaatcagttaacccaaaagagttgtttgatggggtagtaggtgtggaaaccttggtaataaaggaactaagctgacattattattttttaaatttttttagttttttttttttttgatggagtctcagtttgtcacccaggctgaagtgcagtggcgcaatctcgactcactgcaaccttcgcctcctgggttcaagtgactcttctgcctcagcctcctgagtaactgggactacacgtgcacaccaccatgcctggctaatttttgtatttttagtagagacggggtttcaccatattggccaggctgttctagaactcctgacctcgtgatccacctgccttggcctcccaaagtgctgggattacaggcatgagccactgcgcccggcctgatattattttttcatacggtatctattataaatatatatttgaaatatttttcactattatcctaagctaataataataggaacaaagttaccacatgtgcaaaaagctagatgtttagtcagcaaatatctctaatatttatttgcagttcttggttattaccatattgaggatttattctaccttgaaggttaggaaaaatgccacttcagagaaggtttgctaggagaaaaaatttcttccttggcctaatatatttcaattgttgtcaggtgttccaagtgtgaattactgggtattgtactgaatcatcttctatggatccatgtactgcaccttccaaccaacacctctaccccagcacccctccacacacacacactcatcagatactttcttgaaatttgcattaaaataatgttgaaatgacttggctcaaaagcattaagtgaagaacaagacttagaaaaagcaaacctttcattattcttctctgcattaagtgcctagctctctgtgaattgcaacatttttaagaacatatccatagtttgataacctatagatacatagaaattgtctaagtgctaattttccaaactaactgagaatattttaagtgtctatctatatacctctgcctctaggagagtagcaaagagattcaaatatgagcatactcgtattctccttgcttcaggaatctagacgaacatttttacaaaaatatatacacaacactgttcatgcatattatagccacacatattatagcactcacataaacccatctcagagaataaatgaaattgttcaaaaaagagagccagttagtaatcatttgggactctcaattatgggcaaataacgttcattctgtataaaggtaagtacaggattggtgggatttaagagagatgcttgcataggcatctcttaggcaatctgggtcagcttaggcaatctaggtcatttcccaaaatattaaagaaaaaacatccagaaatttctggaaacatcatgtactataatttatatacagtcatgcatggcataacagtgttttagtcaacaatggaccacatatacaactctggttccatagattataataacatttttactgggcctatatctagacatataaacagttaacattatgttaccattgcctacagtatctagtacagtaacatgctgtacagatttatagcctaggcccaataggctgtaccatatagcctaggtgtgcagtagtaggctataccatgcaggtttgtgtaagtcccctctataatgttcacacaatgacaaaattgccaaaggacacttttctcaaaacatccccactgttaagcaacacatgactatacatccacctctttctacatttaaatctttctccttgctaagtttaaaaaatcataaattgaccctgttcaaattgcaatttgtagtcttttaaatgaatacaacttaagtagattagaatgaatgcagcactgagaggcaaaatagcctgaagttttaagttctggaccagacaacttggtgaacttttacaagttatttaacctctgtgcccattttctcatctaaaagcctgggataataataacacctatctcacagaatggttatgagaattaaatgatgtataaagtttctaaaacagtaactggtactgagtaaatattctataagtgtttatcaaccacataaaataaatatttcactaaagcacaaaatgtattcttttcttccagggtcaaaatacactaatagctcttcaaatagcctgctagatctaacagtaattgatgaacacctttaagaataaactgagataaatgagaaaagcaagatatttttgtattgcaatattcagattgtttcctggtcttcagtacacgtgtaaactttcaaatcaaaatagtacattttacactacaattgtatttgtcttctgttgttttgctcttcttttctcataatcaggctcttttttttctagtcccaggaaattttggttcaacattgaactcaaaattacaaaaatgtgaaaaaaatgtgtaaacattactttcatagcagtttgctaatattgaagctgtatagattgaacatttagacattatttgcatttcttcaaagcctagtatcttattaggtaagcatcaaaaatatatacaagaattactcttgtttcttcaataacttcagaataaaagcagaaattaatgggatgggtgggccacatggttatcaccaggaagttattaggacctaacagcatctgaagctggcccttatgatgggaagagaaatggaaaggattcaacaacaactaaaatgtctgttccattaattatcacttgcttataaaagctatatatgaactagaaaaataaagaagatcccactggggaaaaattggatttaggacatacatacacacaaaaacccaaaaatacattgttcccagaacaaataaactgccattctcattgcatacagccatcctcctaaaaccaaatccagccttaggaaaaggaaatatatttcctgaatagccagcaacctccttgaggtcctcttgaatgaactaatatacttctccatgtgtgcccaagccagtgcagaaggaaaaggctgactctctgtcaccagtgtctcgtagagggaagtaatatgatcatctaggtacctcacataaattagaacagatggaagtatgagtttctctttaccagatcatggggttaggatggaatgactttgattctcccaatttaaatcctagcttgcctgaaaatgcaggcttgtccttactgtaattccttcttcagaaaaatatctttaatacccaataagcatagagaaatgaaaatactcagataagatgcatttactgacaaacatatcacatcaaaatttcctcatccagtgcactaccctcttcttacatgtgggagcaaatgtgacccaaggtgaaatctacataaagatgaaagtgaaaacacatagcaatttataggtaatttgtaataaagcttgcagtaagcattactgccaagaaatgcagtaaatccacaataggacttctatcatagctgtaagaactgggtttgtgagagtttatacatttaagctaaatttctcatatttcccattttggctcctcttatcttcagcatattaaataatgaaaaataaagcttaaatctaatcttcaaagtataaattgtcttatggctaaattcaacatccaaattcagccctccactgtgaccattgttaacaacactcaggtaatgtgaaaggcaagaaaagcaggggcctgacataaaatatatttttcaaagtaaacgcccaacataaaatttatccaatattcccagtttactctcaggcagtcatgatgcttacttattttacacattaatatagcttgtgaacatcactcatctactactactactaggtactagggacaatcatggcttggaaaatgcaattcttgtcttcttcaactataagtaaggggacagtttgagcagaaagtcaaaagaggccgggtgcagtggctcacggctgtaatcccagcactttgggaggccgaggcgggcagatcatgaggtcaggagattgagaccatcctggctaacacggtgaaaccccgtctctactaaaaatacaaaaaattagcccagcgtggtgacaggcgcctgtagtcccagcttctcgggaggctgaggcaggaaaatggcgtgaacccgggaggcggagcttgcagtgagccgagattgcgccactgcactccagcctgggcaacagagatagactccgtctcaaaaaacaaaaagaaagtcaaaagaaaggtggtaatatgaaacttctaaactaagagttgatttcctgatttgcatgtgaacatggtaagtagcttgtccaacatcacagagtaaatgctagagtctagaagttctctgagaacaccaaataaataaaagtatataaaatgcatagctcagtgcctggtccatagtcaatattcaaagaatgcagctcctgcgccgatcaaactctcttagtccaatttgagtgtaatacactatcaatcagcataccctggcattttgataatgtttttcgagtttgagaattataaaacaacaaataatgaggcattcttatttagaattttaataaataattcacactattcagaaattttacaaatcagaagatttcaatgcacatttattgaaaatcacttccctaaatcaaattatctaaaagagcttaccaaaaccactgagtatagaaaggttataaaagatcgatttacttaaggtcaattatgcatatgaataatttatctccagtgtttaatgttacttaatctaaggataaaaattatttttaattattaaacttggaatatcaagcaatctctctttaataagctaaacttattaatgcttaaatgtgtatttggaaattccatggaattttgatttgcaaacatcacatataaggtacttcaatatctacttttaatttgtctgaaatgaattaccttgaatatacttaagacatatgctgtatgtaggaaaaaaataaatatgaatgaatcagcatgtacagaaacactaattttaatcagaatatgactttattttggccatttgcttaaataccaagtagtttatttgtttgaggaacaaaatattcatctccactttaatgtaaatgcccttcattccacaaagatcatgttagtaacattcttgcagattctccaacggagaattaatccaattataatgccatttcaaatttaaggttctaaaccagaaaatatagtcaaaaagaatcacaacaatatcagagttgagatcattagaagtcttcaacagctgtaagaacattctcttttcaatgatgctgtataatacaaaacttgtgagagtttactagcccaaagtcagtgataaatagggtaataagacatggacagattccattatctgtatgcactcatcatggggagatgtaaggaggccaacaacacatcatgtttaacagatttatcagccttattttgagatttggtatgaggggaagaattttttaaaagatttacttggaagacttcattctcaatctacacggctatcctttcttttaagttcataaatggatagtaagaggtatgtccccaccctgagttccagctctacacacatcttcaaaaaactcttcttcagtagataatggaattttttcccatgatgcacagatggctaattcccaaggctgtcttcacacagatactttttcttcatttcctcctaaaactaaaaattactttaaaaattttttttcaagaccatgtttccaatagtgcttgtttttcttataaggtgagaagaaaggccttcctttggctatctccctcaaaataattcaattaggaatacagaacattaaagagaatccttaaatgtcaatatgcctttttgtttaattttcatctgtatgtagaaccacgagaagtatgccatcaaattttccagcactgtgcaaacttacagtgaataaaaaaaaataaggtaatgtattttattcctttattatttcaaaaagcaagacaacgagttaacaataacatgacaccaagtatcatatggaaaagtggaaaagtgcccaatcactttaattaggtttataaacaaaaatacaagacatcaagtcagataatcaggaacaaaacaagcttcatctccctcatatgacctcagaataatcagtaatattgtgtatcccttttcaccctggaaaataagtccttcaaattccctttctatggcttatataaagcctgatgtgctccccaaggtttctgtaaatcaccataggcttacatgctcagggagctaagctgcagcttctatcaaagcagttcagtttacggagtatcacagcattctgcagagcagcatccatatgtacaagtcagctcttttccatgactcacacaaaataaaacttggtgttcgaagttttgaggaaggaaatatacatgatagaatgcaaacttaagattatccattaaaaactcttgttcttataggccactccagccattcccctaggggataacatgctgtgtcatcccctttctgttgttcctttcttctccagtttccccctattctgccctccccaaaagaaagtctgaagccactagttgacaattgttgttttccttgatgtggtctttaatttagctccatattgtaagagtttataatctaaatcagtgtttgtcaaactttctttttagcagaggaaccttttgaaaagtgaaattgtacaccaaactctaacatatgactaagagagtagagttgctgtttgaagtggaggcagggagtgaacttggagacttcccttcagcctcatcatctacctctcttgtctaatggctcccagtcactcactgaaagatcaggtcttcatatcatcaagtttgaaaaatattgaactacatacagaataagaagaaactgccaaattaggtacttttttgtatttaagaaataagagaagatgaatcaaagttgacctaaaaattatgtgcccgttacactgggagaaagataacaccattgatagaaatcaataaattgggaaaagcatacattacgtttagtgtcataattagtaatctataaatgtggatttatttcataatgcaattagatgaaatgcatataaagatggtgacttatgaaatgacaaagaattctaaagcttatcataaaacttaagcattttcaaatgaataataaatggccatattcatcaatgcctcccagtattataattacacatttttaattaaatctctgttgatataggataagctaaattaaatttcaacatctaactataaagaaagggactatttataattacccacaaaatagcttctacttgttatactttgccaaagagaatgattatactttttcctatctttcagtaaacctttatatagcttatagctgtctttccagaaggaatctaagttttttataaattgaagacaactaacttatatgagaaagagaatgaaactaacgtttattacatgcctaccataggcgaggcactgtgctgatgcttttatattaccagttttcaattcacactacatactaaaatcgcccagcaatcttttttttttttctgagacagggtctttccctgttgcccaggatggagtatagtggtgtgatatcagctcactgcaacctctgcctcccagattcaagcgattctcctgcctcagcctcccgagtagctgggattacaggtgcccaccaccacacccagctaatttttgcatttttagtagagacggggtttcaccatattggccaggttggtctcgaactccagatctcaggtgatccacccaccttgacctcccaaagtgctgggattacaggcgtgagccaccacgcctagccaggaatctttttacaaaacattttgattcatgagtgtatcctccagagattcagatttaattggtcaaaggtgggggccttcacttgagaaatttttaagcctctcatgtgataataatgtgcagccaggattgaaaatcacaattttatatactttatctcatgtcatcatcaaaacaatctgaccaggtaattatattattccttttttcagataagaaactggaatttcagaaaggttgtgaaatttgccccagggcatagagaaggtatcagagttagaatttaaattcagagttctccgacagcagcgatctttctaacctccactttgtcaaattcaaaacaccagaattattagtgtgaatttagagtagatttctatattttattttactcctggcttcaagaggtggtggagtaaagtatgttttacgttaatttgctagcaaaacacaatattctttattgaactaattaagctgttactcaaaatgaagttgctttgtattttataacataaagtatggaatattttctccctttcaaaatgttcctttttttcataggtacactatttaaaaattattgattttagagtttcttatcagagataagaaggaaaatgcaatgtaaaagtattcaaggaacaaaaagtagattatatttgccaaccattttattttgtcaaccacctttaagggagaaaggtaatttcttataaaatataattatttgttaaacagcagccaaaattaaacagaattctcaattaaaaaaaactttgttttacaaactatatccaatgtataagtattttaaaatataaatacatttcaatattttatttaaactttaaacaagcctatacatattataagttaatttaggaatgttttataacttttacgataagagtaaaatgttagcatgtaatttcaactgtcaagctgaaaataaatatatgaataaccttcattctattacttttcatcttaaaatatatcgttaatgggcttttttttaagtcataccaaaggtgatattaccaactccctaaggacaacgaattctgctaaactagaattcatatttcagagaggagatggataacatctcacaattcaacttcagcaggagtcattaagtcagacacctatgtgagggctgtatttctcattgaattacaaatccaataagagctttgcctttgaattactagcactacaaagattaaatcaatatactgtgaaaaaaggaaaaacccttggatgcttgaagattagaataaaacgcatgaattttttagctcaaatggacaaccatagaagtcattaatcctactttttcattatacaaacccgctacacggcttttgcagaggtccccctttcattcttcacccctccaatcctatagcgactgcactcagtttaatgtcccaaaatgttcatatgagctgtatggcccagcatgacccctaccttgcctacctgcctcccagtctcatctaacactatatgccccctcaatctctgaactgaagccactcagttctttccagaattcacgggcactgagctcttttccccaggaggatgtctgcataaactgttatctttttaggaatgtgttttttcatcttcacctcctacttctcctggataacatctaccttatccttttggcctctaacatagagaggttttctacatcacctctttccctttaaattcaaattgtttcttttttttagcaccctgtatatttctttcatttctactccattcgtaattacgtattaatttagaggactactgtttatgtctatgttaccagtaggctgttggcttcccaagaacaagaagcatgtctctttagttcattaatatatcctcagcaccttttacaatgccaggtgcataacagaagctcaataaatatttatcaaatgaatgaattaactggatactaaggaagagaggtaaagagcagaagctctagagtcaggctgccttggtgccatcattaattcaactacaaagtggttgttaattcttttacctttaaagttagcattttaactagctacttagagaattgttgtaatgattacatgacaataagtaaattatctagtacaggccaaagaaatgttaagttatcattaataattaccaagatataatgtttcattaatgtattatttaaaatatacatgtatatactatgtatatgtgtttgtattaatatatgtgtgtgtgtgtgtgtgtgttgtacattcattcttcttttagttaccaaataatcctattatgtacattgggatatgttgtttattcattttacagatgaaaatacagattgtgttataattgttttatccatgattggcttccatcttctttatcagtactttttttctaagtttttctagcataaagtaaaacttactaagtttggcatcctgcattggtggtataatggttagcatagctgccttccaaagtttgtcatccctaggtcatttgttactgcgttcagaagtgttcccttctcttcaatttttagaagagcttgagaaggattggtattaattcttctttaagtatctagtagaattcaccagagaagctatctgatcttgggcttttctttgttgggaagtttttgattactgattcaatctctatactagttacatataatgatcagattttttatttgttcatgattcattcttggctaagttgtatgtttctagacattcagccatttcttctgggttatccaatttgttagtgtagaattgttcacagtagtcttttaagatcctttctatttctgttgtatcagctgtcatgtctactctgtcatttataattttatttgagtctttttttctcttacttttgctagtggcttcccaattttgtatcttttcaaaaaaaccatctcttagtttcaatgatttttttctattatttttctatgttctcttgtatttatttttgctctaatctttaccatttctttccttctactaactttgggcttaatttgttcttctttttctacttatttgagatgcaaagttagattatttacttaaaatatttcttctttttgaatgtcaacagtcatggaaacttccctcttagtactggttttgctgcattccatgagcttggtgtgctttgttttcaatttcattagtctcaaaatattttcaattgctttagatttattctttaacttgttgtttatgcaagagtatattgtttaatttcaacatacttgtgaattttccagtttttcttctgctactaatatttaatatttagtttcattcaactgtggtcagaaaaaaaaaatacttggtaagatttcaatctccgtaaatttgttgatacttgttttgtaacctaacatgtagtctatcctggataatattctgtgtgcatttgagaagaatgtatattctgttgtttttgatggaatgttctgtccatgtttttttagttgcattaagtctaaagtattgctcaagtctgctgcttccttattgatattttgtctgtatgttctactcatactgaaagtaggatagtaaaatatcctactgttatattgctatctagcttttccttcagttctgttaatatttgctttacatacttaggtgctctgatgttgggtacatatatttatagttgctgtatcttcctaatgaatcaacccttttatcactatataatgtcctcctttctctcttagtacagtttttgacttctgtaaaacatagtactataagtcctagttagagcaattaggcaagaaaaagaaatacatagcatccaaatttaaaaggaagaagttaaattgtctctgaagatgacataatcttacatgaaggaaattataaagactacacacatgcaaacacacacacacacaaatacaccaatgttagaaccaacaaaacgtatcagtaaagttgcagagtacaaaatcaacatacaaataagtatatctgccatgaattaagctcatgtgcaaacatgtgtaattactggtcttgtgtcatctagactactttaaaaaaggtgaaaaaggtcctgtttagttccaaaagggagaaggcagcccctcctgtatgagtggaagctacaaccccttgaaattaataattacaaatcccttaaacccaaggtagaaaaaaggagaacacatatctctgggcatcaataggaaaagactaggtcctacagtaaatatcttagtaaaagaggaggtttgtaaactctctccggaaccagtatttcagactttctatgatgaactaaatgtgccagtaccagagactctaggaaaaaccaggaatttgtttttgcaattagccgcgcatgtagcccagtctctaaatgtcacttcatgttatgtttgtggagaaactgtaataagagatcaatggccataagaagcccaagaattagtgcctacagagccagttcctgatgaattcccagcccaaaaaaatcaccctgatcatctctaggttctaaaagtctcaattattgaacaatattgcatagctagaaaaaggaaagaattcactcattctgtaggaggacttagttgtctggggcaaaaactgtataacagtaccacaaaaaaagcagttatatggtggagttcaaattacatagaaagagatcctttcagtaaatttccaaggttgcagactgtctcggcccacccagaattccaccgggactggactgcccccaccgggttatactgaatatgtagacatagagcctacactaagctgcctgaccagtggacaggtagttgtgttactggcactattaaaccatctttcttcctactgcccataaaaacaggcaaactcctggcttccctgtctatgcttcccgcgaaaaatgaagcatagccataggtaattggaaagatgataaatgacctccaaaaaaaaaattatataatactataggcctggcacttagacacaagatggctcatgggaatactggacccccatttacatgctcaactgaatcatacggttgcaagctgttttagaaatcatcactaataaaaccggtcaagctttgactattctggcctggcaaaaaactcagataagaaatgctatctatcaaaatagatgggctctcgactacttgctagcagctgaaagagaggtctataagaaatttaaccttactaattactgtctacacatagataatcaaaggcaagtagttaaagacatagttaaaaatatgacaaaactgacacatgtgcccgcataagtgtagcacgaattggaccctgaagccatgtttaaaaatcagttcccagcactaggagaacttaaaactcttataataaaagttatgatagtaataagaacctacttactgcttccttgcttgctacctgtacttcttcaaatgataaaaagcttcatcgctatcttagttcaccaaaatgcttcagcacaagtgtactatataaatcactatcaatctattacaaaaaaaaaaagtaacaaaaataaaagtgagaactcctactaataaaaaagtgagagcctcaaaggggggaaaggagggaagagagagaccctctcatattgttttatattgttttatactcagtacctgtttttaaaaaaaacaacaaggaagtaaaaccaaagacaggcagcccagagccacgcctgaaaccaggcctgggcctgcctggcctaaacccagtagttaaaaatcaactcataacttaaaaatcgatgttattcacagattccagacattgtatagaacaacactgtgaaactccctgccctgttctgtttctctctgaccgccagcgcatgcagcccctgtcgtgtaccccttgcttgctcaaatcaatcacaaccctttcatgtgaaatccttagagttgtgagcccttaaaagggacaggaattgctcactcggggagctcggattttaaggcagtagcttgccgatgctcccagctgaataaagcccttccttctataactcagtgtctgagaggttttgtctgcggctcgtcctgctacaaaggaatcatacttctggatttcaaaaaagattacaaagctacactaattaagacagtatggtactaacataaagacagacatacagaccaatggaacagaatagagagcccagaaatgaaaccacatgttatttatcaattaaaaatgaaattaaaaatgttttaaaaatctacatgtgtaaagtcaactaatcttcaacaagggtgtcaagaatacagaatggggaaaaggtagttccttcaacaaatgatgctgggaaaactgaatatccatatacaaaagaattaatttggacctttaccttacaacatatacaaaaatcatctgaaaatggattaaagacttaaacataagacctgaaactgtaaaattcttagaaaaaaataggggaaaaacttcatgacattggattggcaataatttcttgggtatgactccaaaagcatgagcaacaaaagcaaaaatagaaaagaaggattatattaatctaaaaattttctacacatcaaaggcaacaattgagagagaagacacaacctatagaatggaaggaaacatttgcaaatcatacatctatctgataaggagttaatatctaaaacagatcagtaattcaagcagctcaatagcaagaaaacaaataacccaataaaaaaaatggcaaaggacccgaatagacatttctcaagagaaaaaatacagatactcagagtatatgaaaaaatgtgcaacatcactagtcatcaggaaaatgaaatcaaaaccaggagatattaccttacatctgttaggaaagctattatcaataaacaaaaaaagatcacaaatattgaggaggatgtgaaggaaaaggaatgcttgtacactattgatataaatgtaaaatgatgtcacagctatggaaaacagcatggcatttcctcaaaaaaattaaaaataaaaatactatatgatccagcaatcccgcatttgggtttatacatgaagaaaataaaaagtagctggaagagatatatgcactctcatattcatcacatcttttttttttttttttttttttgagacagggtcttgctctgtcccccgggctggagtgcagtgatgtaatcatggctcactgcagcctcgaccacttgggctcaaacaatcctcccacctcagcctccctagagctgggaccacaggggtgtgccaccacacccagttaatttttatattttttgtagaaacggggttttgccatgttccccaggatggtcttaaaccctgggctcgagaggtctccctgcctcagcctctcaaagtgctgggattacaggtgtgagccactgtgctcggcctcacggcatcattatttacaatatccaagatgtttaaacaacctaaatgttcatcaccaggtgaatggataaaaaatatgtggtatatacatacaatgaaatattattctgtattgaaaaacaaggaaatcttgcactgtgacaacatgaatgaattcttgagaacattatgctaagtgaaataagctagtcacagaagaacaaatactgcatcataccacttatatgaggcatatgaaatagtcaaacacagagaagcagagggtagaatggtgggtgctaggggattggggagggagaaatggaaagttgccattcaacaggtataaagtttaagatatgcaaaacaatttagttatagagatatgttgtccaacattgtgcctctagttttcatttgatatattgttcacttaaaaatttgttaagattgtagttctcttattgagtgcttttgtcacaataaataaattaaaataaataaaagtagtaatctctgaagatcaagagagaagaaataacaaaaaagtaaaaatatgaataaaaatacacttctttcttcagttttctaaattatgtttgatagttgaagcaaaaattaaaacagtcttacgtgtttctcaatatacataaaacaaatatttaatatatttatataataaatgagtgagataaaattacataaagggttctacattttcctcaaactggtaaaatgtcaactttattaaattatgataattatgtgtatataatgccatacctcgataaactactaaaatagctatataaagatatatactcaaaaatactatagacacatcaaaaaagaatctaaagtgtattcaagtaactgacaaaaagtcatgaaaaataaattaaaaacagagggaacaaacagaaaacaaattagatggataggtagatagattagacataatccttaccacatcaataattacttaatatacatggtctaaatacaccaattaaaagacagaggttagcagaacagattaaagacctaactcaactacatgctatccttaagaaacttacttcacacatcatgatacaggtatattaaaagtaaaagggtggaaaaagataaaccatgcaaacattaatcaaaagaaagtagctttattaatatccagtaaagaagactgcaaagacagaaaattactcaggagagagggagacattacataatattaagagtcaatccttcaagaagacatagctagcctaaatgcgcatgtacttaacaacagagctataaatatagatgaagcaaaaactgacaaagctgaacggaagagtggacaaattcacagttatagctgtagacttcaacatccttctctcaacaattataagaacaactagacagaaaatcagctaggatatagaaaaattcaacaataccatcaaccaacagattctagtcaacattttatagaacaccttacctaacaacattatttttaagtttttcaagttttcaaatttgttttaaatttttcaacaaattctcaagaccacgagtgggacaaggaaatatcctacaggcagcaaaggacaataagggtaaatacatattatttttaagtgcccattaaactatattaagatagaccatatcctgggccataaaatagcctcaatatatgtaaaaaaaaattagtcacaaagagtgtgttctctgcgcacaatcaaatcaaaatagaaaattgattattgaaagacaacaggaaaatctgcaaaagagaaaacattccagctctcactgggcttgagtttttaaaaaaagaggcagagaaacagaaaatatctcacatcagtaatctaatcatctatctcaaaaatctagaaagaaagcatgaaatacacccaaagtaagcagaaagaagaaaataataaagaacacaaataaaattgaaaatgaaaatcgagaaattcaatgaaataaaaaagcttctctttgaaactatcaagataaaatgttaaaattctagaaaaattaacaaaaataaaagagaagatacaaatttttaagaccaggaatgaaacaaggaaatatcctacaggcatcaaagcacaataagggattatacaaacaactttaacatgtaagtttgacaagttagatgaaataaaccaattccttcaaaagcaaaagctatcacaactaactcaatatgcaacagataatttaaatagctctataattattaaggaagtggaattcataatataaaaactcctggaaaagaaatctccatccccagatggttttcttggagaacactgccaaatatttaaacatatgtaacacctgttctacccaacctttctagaagataaaaaaagagggagtactttccaatcaattttattactaccatgataccaaaaacaaagatattataagaaaactgcaaattaatactcttcattaatagagatgaaaatatttctaataaaatattaacaaatagaattcatccatatgtaaaatgaattgtataccatgaccaagtaagatttattccagggttgcaaggctagtttgatatttgaaaatcaatgtaatctaccatattaacaaactaaacaagaaaaatcatatgattatgtaaattgatgcagaaaaggcatttatctgacaaaattcaacacccatttatcacacaaactctccaaaatctagaaacagagaagaacttctatatcttgatttttaaaaatctatcaaaaagagatctaaagctaacattgtatttaatggcaaaagactgaaggctttccccctaaaataggcaacaaagcaaggatatcagctctcaccacacttacgcaccatatttctggaagttctaatcggtgcagtaaggtatgaaaattaagtaaaagacatacagatttaaaaggaagaaataaaactattcctactatctatacatgacataattttctatgtagaaaatcccaaggaatccaccaaaacgacaataataacaattcctgaactactaagtgatttcaggagggttgcaggatataagataaacatacaaaaatcgattttacttgtatatactaataacaggtgaaaattaaaattaaaaatataataacatttataatacctgaaaaatgaaacaattaggtataagtctaataaaacgtgtacgacttctatactgaaaactgcaaaatgctgatgaaagaaatcaaagatctaattgaatggagagacatcctgtgttcatgaactggaagacaacacagtaaatatgtcaattctcctaaattgatatacaagtttttataattcttataaaacctaagaaaaaaattttagacattaaaaattattgtaaaatatacatggaatgacaaagtagctaggatagctaaaaacaactttgaaataggaaattaataggaataactctaagtgatttcaagacttattatatagctacagtagtcaatgctttgtgatattggccaaggaataaacaaacagcccaataaaatagaatcatgaaactagaaatagccatacacaagtacagcaaattgatttttcacaaatatgcagaagtaatccaatggaggaacaaatagtgctagagcaactggatatcaataggcaaaaagtaggaactttgagaaaagtctcacacttcataaaaagttaactcagaatggatcataaatacaaaatcaaatgtaaaatataaaacgtttaggaaaatagcagaaaagaaattttggacctagaactcgttgaaccattcttagacacaaaaagcatgacacataaaagaaaaaatagataaagcttacttcattagctacaaactgcaagaaaatatttacaaaactaatatctgaaaaggtctcatatatagaatgtataaacaactcttaataattaacagtaaactactatacaaaaaatcctattagaaaataggcaaaaaacatgatgagtcatttcactgaagagtatgtacagacagcaaataaacacatgaaaagatgtttgacatcactggctattagaatgaagatcataatatcactacacactgattagaacatctaaaataaaaaatagtgaaaatatcaaatgttggtcagagtgttgaataactagatacattgctggtgggaatgtaaaattgctctggaaaatagtttggcagtttcctaaaaactatgcatcacataccataacctagcaatcacacttgtgggtgtttctcttagagaaattaaaatttatgactacacaaaaatctgtacccaattgttcatagaagcattatttgtaatagccccaaactggaaaaaacagaatgtcctaccatagtcaaatgtataaacaatggtatatcctaccatggaatactaattagcaataaaaaagaataaactatcaatatatccaacttggatggatctctaaggcattatgctgagtttttaaaaagccaatctcaaaaggtcctacactgtgtaattccatttataaaacactgtataataacaaaattatagaaatggagaatagatttgcatttgccgagggttaggcacggggcaggggcaggtggtaggggtagggaggggcaggtgtgattggaaagtggtagcacaagggagatatttgtagtgatggaatatttctgtatcgtttttgtgttggtgattacacaaacccatatatgtgataaaactatatacataatttatgtcaatatgtcaatgtccttgttttgatatcttgctatatagttacacatgatgcaacctatataggaaactgggcaaagggtacaaagaacctctctgtgctgtctttgctacttcctttgaatctataattatttcaaaattaaaagtttttttaaaaatttagtttctagtctttgagaggtattcctgggacgaaaatgagagaagatggataggctttcccatatagcataaacagctgaactaaaattaaaagcagttatcaagtagattcagtcagttttatttttacaagtgttaggtttaatataaaagtcagaaactaaataaaatgaacagtcaatacttctaaaggagttgtcaaattagaaagagcttgtttctacaaaagacaacataattatcacaaatagtgattatcatatctctgctatgcaccaaacaaaaattatttttctcttcccagttgtaagccaactgccatactaaccgtcttgccaactttgtattttctttgcatattccttttctcctgagcccccagtactgcacttaaaattgccaaggaggaagggagacttagaaactgcaagaggctaaataaacatttgcctgtgactattccacagcataaattatataatcactaggtattcaatgattctaatttaatactgctaaagagggcaggtgatcataacgcacattttagaaatatcaattgtgggtcacctgaaaaagtttcagtcattcttaaatgcaattaccaatatcattataacataaatgcactcagacaaaactaaactcattaaaatggaattctgcaagagtgtaacttacctagctttcttggttttttttcacactggacactagaatctttacccttataattagataaggttcacccacttcagatctctgttataagtgtttaatttatatacactggtttaatttttaacccgagacttaaagaacatgaaagatttgcagggattaactaaatctattctttgtaatagaatccattaataattttctctacatctttctacctactaacatcagttttggattctttctaataaagctgtaactaacaactcttgaccattatggctaaggagacagtctaactcatcctagaataccctctaggctattccctacatttgttgttagggtaattcagatcctttatgttcttctcaaagtaaagtctttgcctaaaaaattgtatagtattatgattatctattattgtgtaagaagccattgcaaaacctaatgtttaaaaagcaacaacttctggccgggcgcggtggctcatgcctgtaatcccagaactctgggaggccgaggcaggtggatcatttgaggtcaggagttcaagaccagcctggccaacatggcaaaaccctgtctctactaaaaatacaaaaattagccgggtgtggtggcacatgcctgtagtcccagctactcaggaggctgaggaaggagaatcacttgaacccaggaggcagaggttgcagtgagccaagatcgtgccatggcactccagcctgggtgacagaacgagactccatctcaaaaaaaagaaaaaaaaaaaggcaacaattttttattctttcttatggttctgaggtttggctgggctcagctgagatttgacacatcaggtctctgagcagctgcagtcaaagtttggctgcagtgggaaccatataaaattttgaataggctagacatacaagataccatatttacagtgctggcagttaatgcgggcttttggctaggaatgcagctctatcaaccagagtgcctacctaattgttatctctctgtgtaggctgggcttcatacagcctagaaattgcattctgaggggaaatgtctcaaagttgagcactccaaaacaatcaggtgaaagctaaaagcctttttataatctagcctcagaagtcctagaatgttacttctgccatatttagttggtcaaccaagttattaagtccagccaagattcaagaagaaaagtattaaactctatctttttgatggaggaaaagcaaagtcatgccagaggagaatttgcaaaatgtgaaatattgttgtagctatcattagagaatacaatctatgacatatagaaaatttcattcctttccaatatacaagtataaaatgccacttgcttattttactggataaccctaggaatgacagcatggtgaggtagctctagatatccctgacctaagtattctctctcctttcttttattaccccaacagtagcatttttaaagttataaaaatatagaggttatcggccgagtatagtggctcacgcctataatcccaacagtttggaaggccaaggcaggtaaatcacctgaggtcaggagttccagaccaccctggccaacatggtgaaaccccatctctacttaaaaaatacaaaaaaattagctgggcattctggctcacacctgcaatcccagctactcaggaggttgaggcaggagaattgcttgaactgggggccagggattgcagtgagccgagatggcgtcactgcacttcagcctaggcaacagagtgagactccatctcaaaataaaaaaaggttatccaacattaaaaacatcatgatgtagccaaattctattaataccagatgtacaaagaagagctggtaccattcctacagagactattccttaaaattcaggaggaggaacttttccccaactcattctacaaggccagcatcatctggataccaaaacctagcagagacacaacaaaaaaagaaaacttcagagctatatccttgatgaatatcaagacaaaagccctcaacaaaatactggcaaaccgaatccagcagcacatcaaaaagataatccaccatgatcaagtagacttcatccccagaatgcaaggttggttcaacatacacaaagcaataaatatcactcatcacataaaaagaacaaaagacaaaaaccactattatctcaatagccacagaaaaggcttttgataaaattcaacacccgttcatgttaaaaacttctaataagctaagtattgaaggaacatacatcaaaataataagagccatctatgacaaacctacagccaacattatactgaaagggcaaaagctgcaagcattcccccttgaaaactggcacaagataagaatgctctcttgccacttctattcaacatcatattagaagtctaagccaaagcaatcacgcaagagaaagaaataaagggcatccaaataggaagagaggaagtcaaactatctctgttagcagatgacatgattctatatgtagaaaaccccatacccatagtcttagctcaaaagctccttcagctaataaacaactttaacaaaattttagtaaacaaaattgacttacaaaaatcactagtattcctacacaccaataacagccaaactgagagaaaaatcataaaggcaatctgattcacaattgccacaaaaagactaaaatgcttatgaacacagcttaccagaaaggagaaagatctctataacaagaattacaaaatgctgctcaaagaaatcagtgaagacgcaaacaaatggaaaaacatccaatgctcatagataggaagaatcagtatcattaaaatggccatactgcccaaagcaatttacagattcattgctatcctatcaaactaccaatgacattctttacagaactagagaaaatgattttaaaattcatttggaaccaaaatgagcctgaatagccaaggcaatcctaagcaaaaaaaaacaaagctggaagcatcacgttacccaacttcaaactatactacagaacacagttaccaaaacagcatggtacaaaaaaagacacgtagaccagtggaacagaagagaggcccagaaataaggccacacatctgcgaccatctgatcttttgacaaagctgacaaaaaataacaattgggaaaagactccctattcaataaatgatgctgggataactggccagccatgcacagacgattgactctggaccccttccttacaccatatacaaaaatcaagtcaagatgaattaaagacttaaatgtaaaaaccaaaactataaaaacactggaagaaaacctaggaaataccatcctggacataggaatgggcaaagatgtcaggacaaagacaccaaaagcaatcacaacaaaagcaaaatttgattaaacctaagagcttccacacagcaaaggaaactatcaacacagtaaacagacaacctacagatgggagaaaatatttgcaaactatgcatctgacaaaggtctgatataagaaacttataagcatctataagagacttaaacaaattgacaaaagaaaaacaaccccattaaaaagcaggtaaaggatatgaacacacttttcaaaagaagacatagatgtggccaactagcacataaagaaaagctcaataacactgatcattagagaaacgcaaatcaaaaccacagtgagataccatctcacaccagtcaaaatggctattactaaaaagtcaaaaaataacagatgctggcaaggttgcagagaaaaggaagcacttatatactgttggtaggagtgtaagttaattcagccattgtggaaagcagtatggtaattcctcaaagaactaaaagcagaactgccattcgacccagtaatcccattactgggtacatacccaaaggaatataaatcattctatcataaagacacatgtacacgaatgttcattgcagcatgattcacagcaaaaacatggaatcaacctaaatgtccatcaatgacagatttgatgaagaaaacaaggcacatattcaccatggaatattatgcagctataaaaaataatgagatcgtgtcttttgtgggaacgtggatggagctggaggctattatccttagtatactaacacagaaacagaaaaccaaataccacatattctcacttataagtgggagctaaatgacaagaacttataaacacaaagaagaaaacagtaaacactggactcttcttgagggtggagggtgggaaaagggagaggagcagaaaagataactactgggtaccaggcttaatacttgggtgattaaataatctgtacaacaaactcccatgccacaagtttacctatgtaataaaccttcacatgtacccctgtatctaaaaaaaggttaaaaaaaccacaaacactatgatggagaaggcaattctgcatagtgctatgctgtctaccatggcagccactggccacatgtcgctattgaacacgaaatatggttagtccagctacactataaatgtaaaatacacatcaaatttcaaggacttataactaaaacagaatgtaagatatctcattatgatgtttatattgattgcatattgaaatgatgatattttgcatacactgacttaactaaaattaatttcacctgttccttttactgtatgtagctactagaaaatttaaaattatctatttggctcacatattattgtagtttgcataatatttccataagatagtgctggctaataaaataaactgaatcatattttccagtatatagtaccacaaaaggtcatggtttttgtaccattaaatggttttcaggcattttaattgcttcttgctaaatcttatgtgagacatataagcatattcaaagtaaatattttggtacttctaggccaggcgcagtggctcacgcccataatcccagcactttgggaggctgagacaggcggttcacctgaggttgggagttcgagaccagcctgaccaacatggagaaaccccgtttctactaaaaatataaaatcagacgggtgtggtggcatatgcctgtaatcccagctactcaggaggctgaggcaggagaattgcttgaacctgggagtcagaggttgcagtgagccgagatcacaccattgcactccagcctgggcaacaacagtgaaactctgtctcaaaaaaaaaaaaagaaaaacaaaatatattgaccaggcctggtagtgcacacccgtagtcccagctattcaggaggctgtagtgggaggatgacttgagcctggaaggtcaaagctgcagtgagctgtgatcacatcactaccctctagcagcctgggtaagagagcaagaccctgccaaaaaataaaaataaaaacaaaataaaaagataaattaatatatttcaatggaaattgatttatgaatataagacagccaagatgatatgagggactcataactgattaacattgaagaaaaataggcaaaaattaaaattcagcttgttttagaaggaaaaaaatattgggagtttatcaaatatttaaaagaaacacatttgcaaactaatggccagtacttagtctcatatccttcctttctttcttccctctacttttcctccaaactgaacttcatatatttcctacaacaaacaacctatgtgattcctgctctgtgcctttgcacaggctcttacccctttctggaattcccaactccctcaactgtctaatgagtacctacttctccttcaaaagccagcttaagagctttctctcctctgaagcctgatccaccccaggggagttaaccacttactacttggtgctcttatagtacttagcattcatcagtattacagtttttatcatgttccatttcacgtacttgtctgtttgattctccttgacaactaagactgcagttgttagtactttgaaaccaccacttcttagcacagtgtttatagaagaattatgtaactagaaatgcagtaacaccaatagcattttaatttaaattttacagtttagctatctgttatagcccatacaaaatctgtcagaaaaatgtgttaaatctctctcaaaatccatcatatgtattcttgtgtttattatatatatacatatgtataatacatacatatatatacacacacacactatagtcatatagtcatatagtttctaggtggccatacctctcagtttgcttgagatgccttttgtagatcaattaaggtctgttgaccattttatgaatctttgtctctcagaagtaacgcagttttggccgggcacggtggcttacgcctgtaatcccagcactttgggaggccgaggcaggcagatcatctgaggtcaggagttcaagaccagcttggccaatgtgatgaaaccctgtctctactaaaaaatacaaaaattagccagctatggtggtgtacacatgtaatcccagctgctcgaaaggctgaggcaggagaaccacttgaacccaggaggcagaggttgcagcgagccaagattatgttactgcactccagcctaggtgacagagccagaccccatctcaggaaaaaaaaaaaaaaatgtatcccggtttggataacaaattacatgtttctcctaataattttctaaacattaccaatagtaaattaaattctctgtgaagccaaatattctgactatagttgctaacacaggataatatttcattgttcaagggctataaaaacaaccttttgatttttgctattaactgttgtagtgaataatgtggtgcttcacccagatttcctttataagggattcccttttcagctggaaataccagctgtgatggctcacatctcttttcctcactgggaacagtcctcagttgcaggaacctgcctcatccaaagttacagagctcctgggatgatatgccatcaatgattgacagttgcaggaattctaagggtccattcccccgtttcaatatgagacaattctgaaaggccatcccagctccaacactccccataggacagctaagatttccattgtaagttggcttctctgccaatctgcctttctttatatgtttccttatatgtttattttctgaaagactgtcccaacaaaacttttttgtactcaaatttactttcaagtctgttctagtgtatatgatctaagacaacaatcactcttcattctaccatcagctcccacctaggaactctactaggctcaggacccttatatttcgtccaagttagaactaatacttcatgccaggattcttgattcttactatattcctgtcatttctaccatttgacctagttttattttatgtaacaaacaactctgagtaaagtttaatgttaaaaaaccatagcaggaacttctaacatatgaggaatgcctaaacactagggagtaaaggaacccacttcttgggaaaggatcagttggaacaatccacaaagtgaatgactgacctgccccacaggtattagaaatcatggctgcctctgctggaaggcaaatgacaaagggctctcaggctttaagctctctggccaagaggatgtaacctttagggactttcacctctgtattgctctctgcttttcacctctgtattgattgctctctgcaagacttaagttttgacactttggaatattctccattactttatagttacttttattttacaaaaattatttcattctcctcctgtgctctggctctatctgattagtttcccttttattaaaaaagataaaaatggctgcctactttttattatttcagcttttcttactagttccgcaatcacatagcttgcatttctgtaggattctcacaattaatttttattattaagagagattagtacattagagcacaaagaagagatatatgagaatagtctgtttcctcaatagaggaacccagatgcctccttttccccaatgagcactgcacaagctcctcttaaaccccaaagtggatattctatgccagatctacgtgacaccaaacttaacttgtcaagaaggatttggaatcattatttaacagtcatctatggaattaaggaacatttagtagaggaataagactaggaacccagagcagctcagaaaaataatagctgaaacaataaagttatttccaaaacaattcacatatgcaaatacctgtgtaatacttagtccttaatttaggcacagaaaagaaatcagagaaaaaaaaagcattttgccaacttaaccagatccccactatttattatttctctcaactcccagcttgttgaatcatcagctcctatattccagcttcaatatctaaatccagcctctttcattgggatgattcctttatatcttcttggactttgactttatgctctaatcaatctgaccttggttgatatctctgtttttggcatatccactcttgcacagacctatataggatactatttatttcttttaagttatccagatatctgtaaactgaaaaacattatctctaaccaaatcaaccactcaaaaatcagttaccactacataataatgaaaacggttaagaatataaaaatgtaaagcatctagtacagtacacttgaggtgataatgacaattctcatatgcagtccatgccaaaaaaaaaaaaaaagaaaggaagggagggaggaagggcaagaaggaagggatggagggaaagggagggagggagggagggagggagggaaagaaggaaaaacataggctgaaaactgcctttacatttttagaattttaattctaacctgtctcttgtattcaaaaagccattgcatattgttcctcccaactgttttaccatatcatcataggaaataaaaataaattaattaattaaggctggaattatttccaaaatgcattttcaggagtgagatggaggtctatacaaaaggaaaaatcccataacatctcttttcgtgtaggctttatatgaattttcagaatttcccaagacatggaatgcattaaactcaagacacacaataaaacaggtttctgaataacaaagccagtccatttgattctttattcactcagcaaatacgtaatgagaaccaacaatgtgcttccacataaaacaccaagagaagaaacaagtgggtggatgagaggtccagaaatgcaaattagttcctgcatggagctcagatctgacttgtttactctagcagcattatctctcactcagttctaataatcccctatagtcatgtatcacctgaatattaactttactaataattatatgtcacctatctaacacatccaacccaactacaacaatatgatttcaacccagtcccagaaaaatatccatgcttggtgttatcttagaactcaaacatgatggctgcctacctacaattctattttcaccaattacagaaagatcaccatgtaaaaataattgatttcctgaagatcattcctttttcacagggcctcgttgctctgccccatttataaaaaaattccttaattatgttatacatcagagaagatgaactaggtctaaccagtcatagagatataacaaaatcagcagaaatatcttagaaatatatatatccctaagttttaaaagacaaaagctatattttttctgatcctaaatgtttcctggagtgtatttttaatgaataaaaatcctgttctagaatagggctggatgtggatccaaatgcagagattaagataaaaaagaatttatttctggatatttacattgatttccagaagagatttaatgctttgcaaaataagaccttttataacaggcagtccattgtataaatgtagtagatgcttgaaactcatttcagttaatgtcagagaggctgtttctccattacatggcatatacaacatgcaatcatttcattcactctttcatccaaaaatacaattcagctttttctaaattctatgcattgtgcctgaggcttgggataaaactaaacaaaacagacatgtgatctgcctgcacagagcttaaagtgtatgagggatgctgtctataatggattcgaaatgaaaggattgataatgattccaccaaagagactagggaagactagtattgatataatgttgtgagtctcccagagatgtccacattcaaattcccagaacctatgaatatgttacctgacatggcaagagggattttgcagatgtaattaaggttaagggccttcagatgggaggattatcctggataatctgggtggctcccactaatcacatgagtcctaaaaagaagagaatctttccaaggtgtggtcagagaaagagatgtgaggttggaagcagggtcagagaaacatgacgttgctggcttagaagatggaggcagagggccatgagccaaggaatgagggtgacctctagaaactggaaaaggcaaaaataatggactcttccctagagactccagaaaataatgcattcctccaacaatttgatttttactccagtgaggcccaggtcagacttttgattacagagctgaaagacagaaatttgtgtggtttaagacactaagtgtgtggtaatttgttacagcagcaatagaaaactaaccaaacatatatacatatgtatccactcatataaatttaacaggacagtatatattagggcaaacatacataatcaatagtgttaagtggttgtctgttttgtccgttatagacccatctcatctcatttcttgctaatttcttcttaatgtgacaagacattgaacttattgaacgttgagattccattttaaaaaatgatcaagacttgctgatctgtttaaggaactgaatttatttagactcagaggagtcatatggttgtgtggactgagcctgagacaaacataagctgcattcatttctcattgcggaactgctctggctggacgcaacagatttgcaaaatttaagccaatctctgaagtccccttcacctaaaagactcacaggttttgatgaattaatcactttcagttttcatgcttatcatcaagcatttgctccatcagcacagctcaattacaaaagctactgactgatctgaaaaacaactgggtccaccaaaggagacacagtattccttaaaatagaaagatgaggacttaagtattagagccatcccaagtctttgagcaaacggtgagcaaggtttgagttcagctagttccagaaaaatgcattccctttcattaaaactgatgcaacagctataaagaagcattatttgtgatagaaacctggagtgacagtaaacctggggatgagatacaataatacactccacagttttccaggttggttcctgctacttaattacacttaattacaatattcattagttcagtccaatttgctcagtttaagaaaaccataaaatcaccattattttgatgtgatatgtgtttattatacacaggggcagcttcagggacctgctactgcacataggatcccaattttagacaggggtcccaggcttgggttttcatgctctgctaccacagtcttgaattttttaacaattttacctgtgaatctgtgtagtccaatgcagcaatgaagcacatgtcttggctcatatgcagtcctgcctccgagtgacttcctgggataggtcctcagccacctgttctcccacccagtgattactgccaccctttattccttgtgggggccttggcacaccctggggtgggtcagggtcatttggtggggccacagatgcctgtgagggtctgcagtcactttataagtacctctatactctagaaatctaacattaaatagcaaataaaaataacctttcataggtcatagtctctcgtgacctatatgtcacgagacatatagtcactttataagtacctctttatatagtcactttataagtacctctttatatagtcactttataagtacctctatactctagaaatctaacattaaatagcaaacaaaaataacctttcataggtcacgagagactgtgtaagaaagctacagttcctttctcctgctttttgaacaagaagcctcacattttcattttgtattaggccccacaaattacgtggccaaccttacctatgtatgtgggtaagtgtgcacatgtatatatatctgaatttgtacctataaagaataaaataactttctattttagataaattgaacttacaattttataatttctaggaaaaataaatgtatatataactttactatattttatctgtaaagaggaaaataataattgtaacagtttgcatatcatgaaagaaggcatttcaataaaatattatcttctaagttttttatgactgatgaattaccttgaaaaatctttaagaatatattatatgctaaaaatggggatattctagcttcaggcattctaggacatgtcatgtctaggacatgacaatactaaaattttcttattaaagaaatctaccttacaactttgatttatcgacaggtgagagatttctggtcaggaaccaaagtcatcaaatattaagagtatgaagatacatcaaatgtgttgaagggtcttcaaaatgcaccaaataattttagtgcatttcaattattcacataattgaacaatctcaaatatcttaaattcatacctgaaaagtcataccctttgtaactaatcattctcaaaacacacctacatgaatcttgaattcttctatttataataatgcagatgaacaaaatattgctattataactttcattttgtttagctctattatttaaggaatcttcataatcaatatataattgaaaatatattcaagatttttctcttcactttataaatattaccaagatttgaggggaacaatagttacagacattccatagatgaagagatatgtatttcatatatatgtataaatacagtgaaacaaaatggactttgaaacaaatatttttgccctaaatttagacatttacaatatttctgatagctaaaacttcaaaaaaaaaaaaaaaaaaaactagacactgtcacatttgaaaaagattaagagctgccaaaactacgtgggtgcctgtaatcccagcactttgggaggccaaggtgggagggtcacttgagcccagtagtttgacaccagtctgggcattatggcaaaaccccatctctacaaaaactacaaaaattagctgggcatggtaacacacctgtagtccaagctacttgggaggctgaggtagaaggatcatatgagcccaggagttcgaggctgccattagctgtgattgcccaactgcacttgagcctgggcaacagatcaagaccctgtctatctccataaaacaacaacaacaaaaaaacataacaacctgcatgggctctttacacgccttcaaacatagctcatgatccctgtaatatcactgttattggatactaacttctaatggcctttcattattcactaacttgatcctgagcaatctgcccctctctttatcttctttatatttcttaaattgatgtgcaactctagtttcctttctccaatcctgattcccttcttcaactaatagtgagatacttccacaaacaaaacaatcacctgtaaatacccttctggttctgatctcatccctagaaattcccagggttgttgttccctgtaaataaccaagcagaactcacttagaaaatcaacctatgtaaaatcacatactcatttgtaatttaccctattttgtatacggaaagtatctcagcctatattcaaagtacaagggaagaggggctagggatgggaaggcaaaccagtcacctacgttgttcatgtactctgaaagcagatcctgaagagcctggcgaatggcgttgcattctgcgataatccgctctcggtgtaagtccctcgtacatgaagaatccgccagcagagcagccccactgataatggcttcaaggcgtttctctagtgatggtcgtatttcctcctcagttactgtgagtggattcaggacaattaaattctaagagaagaacacatttgtatggttagagctccatggcatttcacttttatgaaaaacaaatgttattttgtttttgcatttagaattcagatgtgataataaagagaactgtgttttactgcctcggctggttcacacataatgctatgtagtgattattattctgataaataatgaaagtgatgcaattatgagcttttgttctagcctcagacagacctggattcaaatcttacatttctccctcatgcaggtgtcatacacttgctgagcctcaacctcttgatctataaaagcagaatattaatgttgcgtgtgttgtaaaactgttgtaagaatgatataaatgcttaatacactgactggagcatattaactgttatttacaatagtaacttttatagactgcactgtttatacaatattttcatgtatctcatcctgacagcaccatgaggaagtaggcagcaaagtattaataactacacatttcagctgatgatgagtgaggctgaaaggctgtcttacccaaggtcatagagcaaataaacagtgacgttcagacaagtatccatgtctttcaataccagatttaatattattttcattatgcctcactttaaatcataaactttagttaactttaacactaacatatcaaagtaaattctgaattttaattatttaatttaaaacaaaactgcttcttcctgttgatctattataacttccagctatttccagctattagaacctgacacggtatttttaaggtttccattagacatatcttcaggtaatagaagtcgagataatctacagcctcttaagaaaagatggaaggtatatgctgctctaagggtcttttattaaaatactccaagagaggaagtctttccaagattaggcataatgtgagaattgaagaaagagatagtgtagaataaaagctctctgaagaacccttaacatgaaatgcaatcacataatgatcttcagagtgtgaaattctgagtgtgaatctacacacaaacacactgtgaagatattataagatcttcctagtatataatcttatgtataagattatagatatgtatatgtattttatataggtagaggtgtttaagtatgtaaataagtatatgtgtgtgtgtttatatataaaatcttatacttatcattgtgttacattacattctgataaatatttggggattgaaagtagccaggatacaattttaaaagccacaactgcagagtcaagctaggaagaaaaaattattatagaaaaagatatagttttaaaacattttttttaaaaaaacagcactgtgtaatgttcccttactataaaatgtgaggggttttgagtgagtttcttaatcctgagtcatgagtgaactcccattcacaattgctacaaagagaataaaatacctaggaatccaacttacaagggatgtgaaggacctcttcaaggagaactacaaaccactgctcaatgaaataaaagaggatacaaacaaatggaagaactttccatgctcatgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcccacatcagcaagtcaatcctaagccaaaagaataaagctggaggcatcacgctacctgactttaaactacaccacaaggctacagtaaccaaaacagcatggtactggtaccaaaacagagatatagaccaatggaacagaacagaggcctcagaaataaagccaatctacaaccatctgatctttgacaaacctgagaaaaacaagcaatggggaaaggattccctatttaataaatggtgctgggaaaacgggctagccatatgtagaaagctgaaactggatcccttccttacaccttatacaaaaattaattcaagaaggattaaagacttacatgttagacctaaaaccataaaaaccctagaagaaaacctaggcaataccattcaggacataggcatgggcaaggacttcatgtctaaaacaccaaaagcaatggcaacaaaagtcaaaattgacaaatgggatctaattaaactaaagagcttctgcacagcaaaagaaactaccatcagagtgaacaggcaacctacagaatgggagaaaatttttgcaatctactcatgtaacaaagggctaatatccagaatctacaatgaactccaacacatttacaagaaaaaaacaaacaaccccatcaacaactgggcaaaggatatgaacagacacttctcaaaagaagacatttatgcagccaaaagacacatgaaaaaatgctcatcatcactggccatcagagaaatgcaaatcaaaaccacaatgagatgccatctcacaccagttagaatggcgatcattaaaaattcaagaaacaacaggtgctggagaggatatggagaaacaggaacacttttacactgttggtggaactgtaaactagttcaaccatcatggaagtcagtgtggtgattcctcagggatctagaactacaaataccatttgacccagccatcccattactgggtatatacccaaaggattataaaacatgctgctataaaaacacatgcacatgtatgtttattgcggcactattcacaatagcaaagacgtggaaccaacccaaatgtccaacaattgtagactggattaagaaaatgtggcacatatacaccatggaatactatgcagccataaaaaatgatgagttcatgtcctttgtagggacatggatgaagctggaaaccatcattgtcagcaaactatcgcaaggacaaaaaaccaaacaccgcatgctctcactcataggtgggaattgaacaatgagaacacatggacacaggaaggggaacatcacacactggggcctgttgtggggtgggaggaggggggagggatagcattaggagatatacctaatgttaaatgacgagttaatgggtgcagcacaccaacatggcacatgtatacatatgtaactaacctgcatgttgtacacatataccctaaaacttaaagtataattaaaaaataaataaataaaaaataaaatgtgagggtactccaaaaagttcacgtaaaaagtggagttaaaatataaaaataaaaaatgtaaactttatttctcaacgtaagctccatcaagttcaagaaatttatgcaagtgatgataccagctatttagtctacctctaaagaactgaaggttctgggaattcaactatgtcaatgcagtcttttttacattattaactgaagaaaaataggtgccctttacaatttttttaagattaggaaacaaaaaggagtcagaaggagccaaatcgggactgtaacatggaagcctaataatttcctatgcaaatcttgcaaaattgcccttgtttaataagaggaatgagcacaagtattattgtgatggagaaggactctctggtgaagctttcctaagcatttttctgctaacgctttggccaactttcttaaaacactcttataataagtagttatcattctttggcctcccagcaagttaacagacaaaatgtcttgagaatcccaaacactattaccatgacctttgctcttgactggtccaattttgcttcgactcgattacttccaactcttggtagccattgctttgactgtgctgtgccttagggatcgtagtggtaaagccatgttccatctccttttacatttctttggagagatgcttcaggatcttgatatcaattgtttaaaaaatttctattgaaagctctgctcttatctgcagcttctcccggagcaacatttttgacactcatcaagtagaaagttggctcaactttaatattttagtcagaactgtataagctgaagcaattgagatgtctatggtgttggctattgtttgtgctgttaattgtcagtccttttcaattaagacatgaacaagattaatttttttcccacaaattgatgtggatgttctgccaccttgagcttcatctttgacatcatctcatcccttactaaaatgagttacccacttgtaaactgctgatttctttgaggcattgtccctataaaccttttataaagcatcaatgattttaccattcttttgcccagtcttcaccacatatttgatgtttgttcttgcttcatttttatcagaattcacattgctgatagaggttcttcaaactgatgttttatctttctcagtgcctcaaaataaatcccattctgacatgttacaacaagttagtatgagtttattttggtggaaaaaatgttgaaatccatgcatagttttttataatacacattcttcatgaactttttgaaggccccttatataatgtaaaatgtaaactagaatatagatctgatataaaattggttaaatatcttaaaagcatgcaggagaattcttcctttcctgactgttttcttcctatttttctttttttcttttctttttttgttttttagatggagtctcactctgttgccaggcttgagtgcagtggcgcgatctcggctcactgcaacctctacccccaaattcaagcgactctcttgcctcagcctcccaagtagctgggactacaggtacacgtcaccacatccagctaatttttatatttttagtagagagagggtttcaccatgttggccaggatggtctcgatctcttgaccacatgatccgcctgcctcggcctcccaaagtgctgggattacaggtgtgagccatcacggccggcctttttttcctttttttctatgcctctattgagtctctccatttttctgtcttacatgggcaaaaaaatttttaaaaacatgaaaggaaattaactttacaaaaagcaaatttaacatttctttttctttacccagtagatattatttttgatgaaaccataatccctacaatggggctggccatcagttaaggcttcattcatctaagtcttcctccttatttcatttgccacttttaccacatctttctttggcccactcatttagtacaaactttccactacaatgtttcataacaaaaattaaaccatttaggccaggtgcagtggctcacacctgtaatcccagcattttgggaggttgaggtgggcggatcacaaggttaggagttcaagaccagcctggccaacatggtgaaacactgtctctactaaaaatacaaaaattagctaggcatggtggcatgtgtctgtaatcccagctacttgggagattgaggcaggagaattgcttgaaccgggacccaggaggcagaagttgcagtgagccgagatcacaccagtgtactccagcctagactacagagcaagactccgtctcacaaaaaaaaaaaaaaaaaaattaaaccatttaaaacctttttggaaatgtacttccagtgtggcatcattaagaaaagactatgcaggcaatagaattgctctttaattgctctaatgtaattagaagatgtgatagaaacagtgaatatgtctccagcattgtgacaataggaaaaaactgattacatttcaaatctgtttgctgtaagtactgcaagaaaaaactgccgtgatttttggcagttctggcttttttgccatgttctagctgtgatttcatgttagtaaatagcctatattgtagaattaagttcactctagcttctgctctacaggttcattcctcaaactatctcagcatttggaattttacatgcttgacttttaagacttccgattcttcaagctcatctgaactcaaaccgttgtctgttctgacatctgacacctataggcaggtctcttgattttgcctgaaacaactgtcctactattccaacctactaaagttttcactaaccttgtcactgaatcaataaaaaggcaagaattttttaaagtaaatcaaatgtcctgtgaaatggcactggatttgtttaagaccaactgaaataagtttttacctcttccgatgcacaatagctatgttaaaacagcatttcagtgtgtttcatggcattaatcccatgaaagacaatcaataggatattgttttttcaggatgccactccattgaaatagaaaatatttttccttttttaaggttccactcaatgtatacttacctccttaataatttgattgctgacagaacattattttttaaatataattaagagtcccaactccatattcttctattatattattttgtttaaaagagtaagtatagctagaaatttagaacccaggtcttagaagcagatagcctgggtttgaatcctggcgcatagctataaacaaatatatttgtattgatatcatcctctatatttttatctctctctggagagcttataatttatttgattaataaatttattccttatttttcttcctaccacttcttttcaaaattaaagactttaagtaacttacccaagatcactcagctagtaagtagcagagggaagagtctgtccaaatctgtctacttccagttccatgctataactaccatgcaatgctgcttttgttatcttatttaaccattaccaaccattttgtggggtattatcatcattaatttatacatgtgaaaaccgagagtgagcaagattaagtaagttgtctaataatccccttaaaagagaagatataggattcaaatccaattttatgtaagtaccaaatccatacactttctaccactctggggaaactgagatgagaccacctggcaaacttcttcattcacctgagtctcattatgtttttccactcatttcttctcctccttgtcttcaaggaagacatagtctttctctctcatcattttctttctctctctttatctctctctctttctttctctctctcttatctcccctttgtttctttcttttttgaaaaaaatttgaggaatgtctcactctgtcacccaggctgagtgcagttgtgcaatgatggctcactgcagccttgacctccccaactcaggtgatcttcccaactcagcctccgcagtaactggaatcacaggtgtgtgccaccccacccagctagtttttgtaatttttgtagagatggggtttcaccatgttgcccaggctggtctcaaactcctgagttcaggcaatccacctgccttgacctcccacagtgctggaattataggtgtaagccactgtgcccagtgttcccctttattttcaaggctatcttctcctcatcacaaaccccaagtactcttcaacttttccttccttacattctgagtctcttaaagagcctactctgtgccaggtactgtgctaggaattggtaatagaatggtgagcatccctgccctcctcacagggctcacatctcagaacttaacactattaaccaagaaaatcacaaaaatacgtaactacaatgtggatgtgttgtataaataaaaagagtagttagttaagcacagattgaccagacgtaagtctggacaattaaatgcagaatcaaaatggttaaaggcaaagtagggctaagcacagtggctcacgcctgtaatcccagcactttgggaggcacagatgagccaattgcttgagcccaggagttcaacatcagcctgggcaacatagtgaaacccgtttctacaaaaaatataaaagttagctgggcaaggtggcacatccctgtattcccagctacttgggaggctgaggtaggaggatcatttgagcctggcaaaccagtcattcacagaattcttagggagggatttagatccatagaacatggaattgaaagctacaggtaatcttgatgacaaagatgtagagaaaaggggaatccttgtatgctgctggtagaaatataaattgatacagctatcatgaaaaacagctggaggttccttaaaaaattgaaaatagaactatcatataatcagcaatcccactactgtgtatatatccaagggaaatgaaatcagtatatcaaagagatatatgtactctcatgttcactgcaccattattcataatagccaagatatggaatcaccctaaatgtctaccaatggccaaatggataaagaaaatgtagtatatatgcaatggaatactattcagcctttaaaaagaaaacaatctgcagggtgcaacgagtcatgcctataattgcaacattttgggaggctgaggtgggtggctggtggctggtttgagtccaggagttcaagaccagcctgggcaacatggcaaaatctcatctctacaaaacatacaaaaattagccaggcgtggtggcgcatgcctgtagttccagctactcgggagactgaggtgggagaattgcttgagcccaagaagtcgaggttgtggtgagctgtgagcatgctgctacactccagcctgggtgacagagcgagaccctgtcaaacaaacaaacaaacaacaacaacaacaaaaaaaaaaacagaaaattctgtcatttgcagcaagatggataagcctagaagacattatgttatgtgaaataagccatgcacagaaatacaaataccacatgatctcacttgtatgtaaaatccaaaagaatctaactcggacacagagtggagtggtggttaccaggggctagggggcagggacaggattcaggagatgctggtcaaaagattcaaaattttactttgacaggaggaataaatacaagaaatctattgcataacttggtaactatagttaataataatgtactgtgtacttgaaaattgctgagagtagatattaagtgttcttaccacaaaaaaataagtatgtgaggtagtgcatatgttagtttcatttagccactgcataatgtgtatgtatttcaaaacatcatgttatacaccacaaatatacataatttttattcactaatttaaaaaattttaaatgaactgctaaaaaacagtctggatgtgatcttatccagattttatgttatcaagtcttcctgaacaggcatcagcattataattatacagctagaagcagaaagactgaaacttgaaaacaagtcaaagagaagacaggtactttacatctgagtaaacaaaaaaactgcatcaaaggtagggaagggatctgtgaaaccaggagaatacatatttcattcatctataggagttttaaaaaatctgacactatgacggaatgattaaaattaaaataaattgcaaatatcaatattttaaaatacaaaagatgtataccacccacagaatggaagtatgagaaccaattcaaatagtgatgtggggaatgtcttatattaaatcatttaatggagaatatgtagtttacgtaggcattgctgatcatttttctttttggttgtagcctaaaggctatcttccagaaaataacttataaggattattttaatcaatatgacttacagtgaaagaaaactctatggcctctagaaacagaaataattgctacattttgagaagactgagatcatggctctacatgtatttgagtgaacaatgtgggatgaatctatatataatagcttgaaaaattgccagaatatatgataaaataaaaaacagaagtggcaggatgatatatataatgatatcatatatatttttaaaacgagcacacaacaacactttgtattttctctgagtgcatatgtgtatatgagagcctaggaaaaggtctaaaggaaacataccaataccatagcaattattattttggggggaggatgagacaagaacccaaactggggtagtaaagttttaattttttaataactaggcttcatttcatattacttataaaaatacaaagtaattaaaaattcaaattcttaaattttaaaaaagataattatggaccaaacgtttattactcttttagattcaagtattaatcaactaattattttggaatcaaatagacaaaatgctttctttgtttaccagaatgaatataatattatttttaaattaatcagttgcaagaatttcaattttattatgttaggtttacactgtttaaactattacaaatatgtttggctaatatatgtcttttaaaaaataaagacatcaagagagtgaaaaaacaagacacagactgggagacaatatttgtaaaaggcatatccgataaacgatattatccaaaacatatgaaggattcttaaaactcaactataaataaatagcctcatttttaaaaataggccaatgaccttaacagataattcacttaaacatatatacagatagaaaataagcatatgaaaataagcataagtcataagggagatgcaaagtaaaacagtaatgagataccactacacatctattagaatggccaaattccaggacactgacaacaccaaatgctggcaagaatgtggagtaataaaaactctaattcactgctgataggaatgcaaagtgataaagccactttgaaaaacagtttggcggtttcttacaaaattaaacatattgtcccactctcaccatttccacttaatatattcctggaagtcctagccagagcaattaagcaagaagaagaaataaaaggcatacaaatcaggaaaaaaagaagtaaaattttctctgtttgcagattatataatattatgtatagaaaacccaaagactcaaccaaaaacctattataactagtaaacaaatccaataaagttgcaggatacaaaaccaaagtacaaaaatcagttgcatttctgtatgctaacaacaaactatctgaaaaagaaagaaaacaatgcaatgtatattagcatcaaaaatataaaccacttagaaacaaatttaaccacagatttgaaagatctgtggttacattaaaaattacaaggcattgatgaaaaaaattgaagacacaaacaaatgaaaaagtaccctgatgttcatggattaaaataattagtactgttaaatgtctatattacccaaagtgatctatagagtcaaaacaatctatgtcaaaattctaacagtattcttcaaagaaatagaaaaaacaatcctaacattcatataaaaccacaaaagaccacaaatagccaaagcaatcttaagaacaaaactggagggatcacacttcctgatttcaaagtacattacaaagctatagcaatcaaaacagtatagtactagcataaaaacatacacaaacaccatttgaatagaattaagagcccaggaataaacccacacatatacagtcaactaatattctgtaaaagcacaatggggaaagaatagtctcttcaataaatggtgctgggaaaactgaatatttacagacaaaaataaaataaaattcgacccttatctacaccactcacaaaaattaacttgaaatggataaaagacataactgtaatgcctgaaactgtaaaactcctagaagaaaacatagggtaaaagattcttgacattggtctcaacaatgtctttttagatgacaccaaaagcacatgcaacaaaagcaaaaagatttaagtgggactacttataaaaatcttcttcttctgcaaaaaatcttctgcaaagcaaagcaaacaaccaaaaacatgaaaaggcaacacacagaaagaatgggagaaaatatttgtagaccatgtattcaataaggagttaatatctaaaatatagtaggaagtcataccactcaataacaatataataataataatccaattaaaaataagtaaaggcgctgaatatacatttctgaaaaagaaaacatacaaaaggccaatagtgcattaaaagatcttcaatagcactgatcatcaagggaaatgcaactcaaaaccacagtgagatattacctcacacctgttaggatggatattattaaaaagacaagagataatatttgagacgatgtggagaaaagggaacttttgcacactgctggtgggaatgtaaattgatacagtcataatgaaaaaaagtggggagattcctcaaaaattaaaaatacaactaccaaaagatctagcaattccacttctgaatttatatctgaaggaattaagtagcttgaaaagacatctgcactcccacattcattccatcattatcacaatagccaaaacatggcaactacctaagcatctgcagatgaatgaatgaataaagaaatggtcatatatatgtatatatacaaccacttacaatagaatagtattcagctataagaaatgaagaaaatcttgccatttgtggatgaacctggagggcattttgctaagtgaaataagccaaacacagaaagacaaatacaatatgataccacttatatgtaaaatcaaactgttttgattttacataaatcataaaaacagagtgaagcagcagttgccacagatgagagggtgtgggaaatggggagatgttgaccagtgggggcaaactttcagttataagataaataagttctggggatctaatgtacaacatagatggtaattggtatgttaattaatatgattggggtaatcattacacaatgcacatgtatatcaaatcatcacattgtgtacctttaatatataccttctttgtcaattgaatatttaaaattgttttaattcaaattttaaaaactaaacataattttcctaaaccttttaagtcggagtacctgtgcaggtttgttatataggtaaacttgtgtcatgagggtttgttttacagattattttgtcaccaggtattaagcctaatactcattcattattttcctgaacctctccctcctcccaccctccaccctctattaggcaccagtgcctgttgtttccctttatgtgttctcatcatttagctcccacttataaatgagagaatgcagtatttggttttctgttactgctccagtttgcttagaataatggcctccagctccatccatgttcctgcaaaggacataatctcactctttttatggctgcatagtattccatgatatatatgtatgagattttctttatccagcctatcattggtgggcatttagtttgattctatgtctttgctattgtgaatagtgccgcaatgaacatatgtgtgcatgtgtctttatgacagaacaatttatattcctttgggtcaaaatgaatttctgttttttaggtattgaggaattgacacactactttccacaatggttgaactaatttaggctcccactagctgtgtataagtgttccctttgctccacaacctcgccaacatctgttatttttttactttttaatactagcctttctgactggtgtgagatatctcattgtggttttgatttgcatttctctaagatcagtgatgctgagcttttttaaaactatgtttgttggctacatgtatgccttcttttgaaatgtgtctgttcatgtcctttgcccactttttaatggggttgtttgaaaaacaaactaaacatactttacaatataacccagcaattgcacttcttggtatttgcccaaagtagtcaaaaacatgtccacacaaaaaccttcacatggatgtttatagcagctttattcataattgccaaaacttggacgcaaccaagaggtcctttagtaggtaaatggataaactgtggtacatccagacaatggaatattactcagcactaaaaagaaatgagataccaaaccacaaaaagacatagaggaaacttaaatgcatattactacatgaaagaatccaatatgaaaatgctgcatcctatgtaattccaactacagtatatgacattctgaaaagggaaaaactatggagacagtaagaagtcagtggttgccagtagttagcaaggagggatggaggaacaggcagagaacagaggatttttaaagcagtaaaaatactctacatgatactaatggtggatgaattttattatacatttttccaagcccacagaacgtacaacaccaagagtgaactctaatataaactagggattgtgggtgataacaacgtgtcagtttagttcatcaattgtaacatttgggggatattgataatggggaggccatccatgtgtaggagcaggggatcagaacacaatgaggggaatctctgtaagtttctctcaattttgctgtgaatctaaaactgctctaaaataaagtcttaaaaataagaaaaaaattagtattacagaaaagtcttctagtctttaatactaaaaggctgaaagccttttatttaatactaatattccctataaggaatctgtactccatgaaaggttgctgattttatatcttaggatgggaagaatcaaaatgtgtctggaatatctggtggccactaaccaaaatcacttaaaattagcagggatgatagcaaaagaacaaaggagtccagtccatttaaaggggctcctactatttaattcctgataaattgagtattatttagacatattgagtctggggagccattaattcataatgctactcaaaaggtaaattatgaaaatgtttttactaatgaaataaatatggatacttatctttaagaaaattagaagaaaataaagacatatgatctaaaatagcagggctctcttattcagtggagctctggagtcagaaaaactgaacatgaattttggccccctactcacattgggaaagtggtttaagctgctgaagcctttattccatccctggtagaatgaggaaaataaaatctacacctaccatacaggactttacttaatgtagctttataacatgttttaatatcgggggcggggggcgggtaggctccacctcagtggtctccttgctaatgttattttttgcatttaaatgcactaccatctatacctgatgaataaagccatagacccatatgaaggaagcagcttttcctaaacagaacactccaatataccatacagatgtgtatcgttccaccaatatttattaatcatccaatatatttcagattctgaacaaggctgtgaccatgccttaccaggacatgtagaacttatacacagtcttaaacaagctgaagcacaaaatcaatattttggttggaaaaagttttctgtattttaataacatgatggaataaatgctattcatcattcacatactctatattctctgatgggattgacctgatttacactgaaaatactaaaaatcttacacctattctccaaagtgaaattgcctatcaaatgagatgcagctacaattataatcaagtaccaacattcttcacaaaaacacatgctatgcttcacgttgagagcagcagaaataataagcacacagcataagtaatgtttctcaagcaactatattatcaatcttcagaatgagtgataaaaatggaatgaaatttttccttatgattaccaatagaaaatgctattgagagagctcatagactcccttttgtctagtatatttcctgttttaatgcatttctacttaatctaaagaatagaagctttagatataaaaaaaattttaagaaggcaaaatgtgaacaataaactaaattagcaagatgatcaatacaaattatttatagtactttggtacattagtgtaatctacacatacaaatctaaatacatacttagctatagtaagtcaaagagtacataacttgcattttgttgtgtatcaattagcacaacagaaaaaaagaaaatattttagagatactcaatatacttatcaattaaatataatacatacagactcctttaaaaatcttgtaagtaatgaacatattacatttaaatggccctaatactgtaatgatggttaaaccagaacagtgataaaaatttcactcatctgatttcactcatttcacctaaggtagtaacgtcttctcctaggcatatttctgtcagttaagcaaaccagcctatgcacagcaccacacatcatgaattctttcagttttttatctttttatatcaataatatgataaactttgaaggattctcctactttcacaatctctgtataaaagaatagtaacataagcacctccaggaatctgttgattttgttgtgatattgaatattatattgaattaatcttaccataatattatagactgaggcaatatatattaatgaaagagtccttgtgtgattatctgtttggaaatatgtgtttacatgtttgtgttttacatggtctgtatttaaaatgtgtaaaaaatcctaaaaatatagacgcaatggtgattaacttattctgtctacattgaacttagagaaaatacagatgatttttatacacaataagattgtcattaaaactaaagtatatgccccaatatttttaagtatattaaatcttaatttctcagtaacatcatgtgtgtcccaccttctatgtccatgaggcttatgattccaagcctaaatgacaacaaatctgcaaaatttaaacaaacatttgaatagttcctgtcatttccgaggtttatgtcaattgttattcctgtggagttctcccagaaaacaattcatcgacaaagaagaaaagaaaaggtacacagggggcaagtggaaaaaataagtaatcccaattgtgctctatttctgtttgattctacctttcacttctgtctataatgatgtcctttgggagaaatagcaggttaagtacaagccctggattcatgggtgaattgtgcatagtagagcattaaaaaaaagtagctgatatggtgcagtcttaccttgcaactgtaaaattctcaaagtcatatctgctgtagaattccttaacaatgatgagtgtgaaaatgactgctgggtggtgacagtttctcaataacagcatccttcagatgttcttgatgtggtccctgaggtcttccccatattctctagagcactgctgtttaaggattgtgggtattctgaacattttgaaattacaaccaactaaagatgttcttggtatgaaaagagttaaaaatctgctcttttcctggagtttaatatccagttaaatagaaattaactcaaatgtttctaagtcattttccagttaactagggcttaagaaaaaaaaattgctgtagtcactgtgtttaaaattttactttaggacgtattagcctataagtgccacaaaatcatcattttggagtctacataaagctacattgtcttggtaagaaattgcaaagaaactgtattgactctaaagtacactctggagtactgcccaaaagagcaatctatgttgatgaaaattttctgtatctacaatggtcaacacagtagctactcaacatctgaaatttggatagtacaagtaagaaactgaatttttagtttatttaattatgattaatttaattttaaattgaaaagccacatgtgagtagtggctactatattgaacagcacagctcttaaagttgattttcactgtattttccatatgagattatgtcatgatatgttgtgatatcctttaggtatctaggtggttgatggttgattgattgtgattaaaagcactatttccctaagcaagtgggtatctttggagaaagcactggtggaggataaaagtttaagctgttgccagtcacgaaggtcttactttatcaggtccttttccctaacaactagttgagaatgagttagactaaaaaagaggcagctccagagaatatgagtcacagtgtggaaggacaagaagcaagtcttatgtggctaggatatagagatactgagcatcagtgggaagacagggaaaagatactctgagaaaaaagaattctgagaaggaaaatggaaaggacaatcaaaggcaacattcatctatttcacagtttaattcattctgctctgttttatatccttctctttttattaatgaaggatgttgctggtgctgttctcatagggtgtcgatgcaagactgaaaatgtcagtccctggcttaatatcctttccaaattgagaagacctgtagaaaaaatcaactgttcgtgcattttacactgtttggatctttttgctttgctagttatgtaatgacatacacaaaagttggtcagaaaaatgttaaaccaacatcattccttctgctatgctttgatatttatagtctttaaagtttttaccaaagagccttattttttcccttggtgctttatcaatatgatttacatttttcatcctattaaggaacaagaacatgtgcaatataaggaggagggggagatggaggaggagaaaggaaggagagaaagaggagggagatgtaaaaaaaataaggtaaagggggaagggaaagagaaaaggggatggaaggagagttgagaaggggactgacaggatagaagaggaggaactgggaaaagagagaaagtgacaaaaaaagaaagtgaaagtaaagaaacagtttgctaaacactcttgtgtcattcacactgcaagtaataaaaccaatacgcttctgtgtttcatgattcaagagaacatttaagtgataaagggataactgtggaggtacctgacaactttgccaaataaaaatccagctttcatcactatagaaaattttaaatggctacaagttttttttgtttttcctttttgttgttgttgttgttgtttttccagatggagtttcgctctgttgcccaggctggaatgcagtggcgcattcttggctctctgcaacctccgcctcccgagttcaagcgattcttcttcctgagcctcccaagtagctgggactacaggcgcatgccaccacgcctggctaattttttgtatttttagtagagacagggtttcaccgtgttagccaggatggtctcaatctcctgacctcatattccacccacctcggcctcccaaagtgctgggattacagacgtgaaggtttttgtatttttataaagtgcaggtgttcagcatgtcccttcctgaactttacaatattcacatagctttggcaaatgggatgcaaaacaacattcagaatgaaattaatgttgaaagagtagtatcatctacataactagactatttttcaagtagatattgacgttatgcagtgggatgtgctattaaagagcataaactatatcctttaaatttaacaatacataattccatcaagaaaaatcccatcactgaacaccgctccagacttttcttatcaggatattataaaacactagttaactactacgaataccaagcaaaagtatggtaagaatactttgccccttttctttgcagacaggaaaaagcaattgaatatgaaggccaaaatctctgagaaggagtgctttatctagagagacaagcaggggcacatatcacaatagcgaacaggagagatatattgggtcctgatgaaaactaatataggaagaaattggctgaattttttctgtaccctgtatgagaaatgattaaatttaaagggtttttaaattaacttacttgtgaccttgcctgctattccatatttgaagatctggtggggggaaagtatgtagaaacttcaaaatatgctcaggaatgcatgaataaaaaaatagaaattcttactattgataaaaagagaagagaatccaacttctcaatttaaggggacttttaaaataaagaaaggcagtttaatactccctaaagaaggcataaaattcctatagaaccaagattcttggttgatactgcctctgcatcagcaccaaaaattatccctctaaacatcggtggttccaaggaggctccttggtaaattgtagcctgcctgaatgaggtaaagtgatcccatctccaaatcaacccataccaggaaggccaggaataggagtctgtatcaagtcaaaattctttaatgccttcccatgctcaagccatgacctgcaaagatgcccacaagtcatataccaggtagacaatactgctcagcctactgccctttcctcattaactccctaaagcccaaaagacagtcacgcatgcacttttctttccgtttcacaaaaacaactgtaatgtgaacaccatacacattataccttgttacaaatattttaagccctatatttaagttagaaatattaagacttagaaattcctaagtattagaaaatatcaactaaaacagactattctcactatcttcagtttgatgtgtctcagtatgtgtttcctcctgttttttcatcaaagggtcaattgaccccaacggatgctctctctgtctctgggtcactcatctgtttggctgtatctatttattacattgcttcatccatcaccggagttcctactctgcattgggcctccctccctgtccataagactgactcaacactcacatgactaagatagtaatgtgaggaaaaaaatattgtcagactcattctaggcattgaagaagcaagccactatgcctgttagagacagcatggtttccacgtgaaacaaataggattagtctacctcctataatgcaactacctttttcaaaactcatggatattgtcaggctgcttaacaaatataacctccagcagctgcagagcagatccatgcatctgtacagtacatgtttgcacatactccttttccatctgcaggacatgacatatgccaattgattggcttatagtaggcttggagaggagtcagagtattggcaggcaccttatgtctattcttttttttttattatttttttattattatactttaagttttagggtacatgtgctttccattttttccttttactctgaagcttttagacattgctcttttggatcctgcctaccaaattattcatttaacttcaagtgttcatttgtggctaacgaagctgagatttttgttaacatataacttgcatttagtccaaactgattagatgtcaataatcaacctaaattatcaggctttactttaattgcaattatatcctccatttcacatgtttaaaggtgagttcttatcaggtgatgggaactaagcagagtccaagtcaacctgaaagaaaccaaaagattcatccacgatcagctacgtgatttggaaggctcagtgcaatgtggaagtataaggtaccttgttcaaaatatattcagaattttaatatagcaacctcaggtaattaaaccaaatatgagatccttccatctgtgagacacacccatgaagagagccctggatttgtcaaagaaaacataagacatttttgccatttcttttaaatgttaatcacgcttatgataaaaactaatatgttggcaatattttcttcaaagtcaatagtatcttcatcaaaaatttctttttagaatttacaaagacttctttttccttttcgattggtctcagaaaacaagctttgaggttctattcataacataaagttcaattcagtttcaaaaaataattgcccgatacccttcttgcctttccaaatcttactgtaaatacaaaagtatgaaaataaagcctgtaaattatagatccatggctagatttggaaaaccctaaatcttaaacttagcagtgaacacctgacagtaacaaaagccataagcgctcactctaggaacagcatggccactgaacaatgttctccataataaagccataatcaacaccctacaaagcaaaatactatactatgatccacactactaaccatattttatcaaactgtatcttaaaacaaggaactctacaacttactaccctccatctcttgataaaagtaaaaacagattcctctaaattaaagctggaattcgcaagaccaaactaataaaaactaataaaaattatgttttactaatttttaatgtaagaattaataattctcataggctacttctcttttcttgatttcaccttactctgagaacatgtctaaaataaacatcattccattttgaacgaagtgctttatccaacagaccgatcatgctagacagaaagtttgcaccaggtggtagaaaaaaaagaaaactgtaatatcactttacatagtaaatgtaaccttccaaaacaaatttttattatattattatgatggtacctacagccatataaaaagggaactctggacatatctgctttaaaaaaaagctagataatcttctgaacttggaataattttaaccaacattctttaaggaatacttatggaaataattaattgcttattttagtttacataccatgtatacttgtgttaaaatgatttacctcctaaaactaactccaaaaaaaggtatttgaatactcagaagcttgtatctctttctttttggctgtctcccttgttccatttcctatcttacttctcccaattcagtttatcctctgatatggtttgactgtgtccccacccaaatctcaccttgaattgtaataatccccatgtgtcaaggacagggccaagtgaagataaatgaatcatgggggcagtttcccccatactgttctcctggtagtgaataagtctcacgagatctgatggttttataaaagggagttcccgtgaacacgctctcttgcctggcaccatgtaagaagtaactttgctcctcattcgccttccaccatgattgtgaggcctccctagccatgtggaactgtgaatcaattaaacctctttcctctataaattatccagtctcaggtatgtctttattaacagtgtgagaacagactaatacgccctcctactgaagatatgatgtcaccattcttccaagcatagatccattggatatctaagctatcttgggccacttccagtcactacaactgtcagttcttttttcatacctatccctctcctttccattccaactcctttacattgggtttttattacactttacctgaaatattataaaaatatcttgatttttcttgcttccattaaaccatgcaaaataatctacacatcattactgattaatcttccacaatacctgtttgattgtcccttccatgacaaaatattcctcattaacaaagtccaaatttcttagcttggcattcaatatggttcctcaaaatctggtttccaagccagattatcttctcacctgttgcagatactgtaatacggtattaatgagcttgggctggaaattcccatttcattactacagaaaaggtgtagtgatgttacctgcaggagtaattgagggagttccaagtcttgtgactgctggaatatggctggtaatacagaaaaggagtgatattagccctctctttaaaagaagaaaatatgaacttaggaattcaacttcctaagaaggaaatgggcttttattagaaggaagtgataaagcaaatctcttagacctaaaagtatttttttcccagatatgtactatgaaatgtcttgattcctgctgatatggtttggatacgcacgtccccaccccaaatctcatgtcaaaatgtaaccactaatgttggaggaggggcttggcgggaggtgattagatcatggaggcagagttctcatgaatggtttagcaccatctccccttggtactgtagagtgagtgagttttcatgagatctgcttgtttgaaagtgtatggcacctccccccctctctcttcctcctgctccagccatgtaagacatacctatttccccttcaccttccaccacgattgaaagtttcctgaggctgcccagaagctctcgtgcttcctgtacagcctgcagaactgtaagccaattaaacctgttttctttataaatttcccagtcgcaggtattcatagcagtgcaagaacagactaatacagctactaataagaaagctgaatttatgggatctaaaacaaagtatgttgatctactgattaatcaaactgacatgacagtccggaaacgacccaatgggttcttcctgcccactgcacaaagccaattcactaagaccacagcattgcaataaagattttaatagacacaaggtcagctatgccatgtgagagatggagttattaccaaattaatctccttgaaaattcagaggctagggtttttcaaggatagtttggtgggacaaggagtcagtttgggtggggccacatgacagatgggcaggggtagactgtcctcagaaatgtaaaaacctgaaaagatatctcaaaaggccaatcttaggctcgctctgtaatagtgatgttatctgcaggagtaattgcgggagttgcaaatcttgtgacctccagaataatggctggtaattgtttatgtctacaccttagcagaattcaggatcctcatctcttcgtaacctggtggtcttttattagctttacaaaggcagtttagtttgggggaagggttattaacatttaaactataaactaaatttctcccaaagttagcttggccctggcccagaataattaagggcagtttggaggttaaaggcaagatgggggttggttatatcagatctcttttatgtcataattttctcatgttttattttttgcaaagtcggtttcagtcccaagtaagaccaactttaattctgttctgctattcatccttaatggtgtgttcctgtatgaaggttttctggcagataaggggcctcttactagtaaataattttatttagttcttatttacccaccaaaattgcaaactctcatatatttataggcatcagagttttgtaaacccccttttagataactgtgaaaagtcattaaacattctatcaaaatctcccatccttcaaggcctagctcaatttcctttccataaagacttccctgtttgcttcttgctaggttacaggaggcttgagaacagagtgaagtgtggattcaacaaacatttatagaacaggtactgtgctaacaatttacccctcagttatactcacacttgtatatacagaacaatctctggactaaaacaccaaaaaatggtttaaaatacttgtttctgaggaaaaggtaaggataaatacagatcttaaaagaagcaaaatataattttcctagggaaaaaagggagagacacgttaccatttactttagaaaacttgtcatggtgagtctttctctgccctttgaaacgtatgtaaatcttcttaaaagtgaaataagcttctcgccagcttttcaacccaaggatgaaaagaatcttgggagaatgtctttctcaagaacctggaaaccatctcttttaaatataatcatcaaagaacgtagtgtccctatctcccagtttctgtgggaaggcaggagcctaactttggtgggtgcctggctccaagttacaaacttgtcttctgtcaaaaagatataaaaagttcctttggataaaggcaattagtgaacagagacagttattcaaattaccaggtgagtttaggatgaactatgtatgtaaatggtactgtcaagtcctcttacttgaggaatagttatcatttatcttgagaacatgtatctaatgggttgtgtctcctaagctatataaaacattgagatttctttatgtctctgcatttctttagctgattgcctgtggtatatatcacattctggtttaatgcttatcaattataaaattgttttcctttgtgaagggtatcctgggttggcaggatatattgttttaaattatatttccccaaaactcactggagattactgtatcatttaaatatgtaaatgtgcaaatgttttaacttctcaataaaatgaaaggaaccaattaagaaactaaagaataaggagggaaattgtggaagaagaagggaaaggaagaaaagagggagggaggaagaaaaacaaagaacaggctattagcaaaaactcaacaaaaagcacttccacttagggaagaaaagaccttcaaaaaaaaaaaaattaagagtttccaacaggactctagaatcaggcttctagagcctgcacctgattctagaatctagattctagaatctagaatcaggactctagaattcagtctctactgaacatattgtctgcgaagtaattaaaggggagaacaatcaagccaatatcccataaaaactaaaaccccttctcaaaacaactcacgcctgtaatcccagcactttgggaggctgaggcagatggattacttgaggtcaggcgttcgagaccagctaagccaacatggtgaaaccccgtctctactaaaaatacgaaaattagctgggcgtggtggcaggcgcctgtaataccagctactcaggaggatgaggcaggagaatcactggaactcgggaggcggaggttgcagtgagccgagatcgcaccattgcactccagcctgggtgacaagagtgagagttcatctcataacaaaacaaaacaaaaattgtaatgcataaaaataacagatacaattttaaatggaaatcaattccattgacagatataattttttagtcattatattaacatgaaataataagatctagcagtcagcctaataactctcataattcagacatagtgataagcatacatgacataatgtggtatgaaaatatctgtaatttctataggtgacaaagtcttaggtatcttatgcactgtggtttgtatttaataatattaataactaaagtgataaatttcagatagaactttataaaataaagaactatttatttttctcatccaagtccacagacaccctgaattctacatatgaatccccatgaactgtagcttaagaacctctgtgggaattgtaacagaactcaggatgagttctgctaccagaaaaactaggcaagtctaccacaagagacaagaagcttcttctccaagaagataaactatttgctttccatgttctaaagggccacctacatctccatgttgccctccctccagtatagcgacttgacctagcattcctagaatcagaaccttacaatcttacaaacctgcaagattacccgaatactcagtctaactgaaaaatatacagcagctaataatactgtataatctagattaatggtttggaacatttagtgtgcttaaggatcacctgggaaggctcgtctttgaaaatgattcatgacctcatcatcagagtatgtctaaatttgggaacagaaatcttcacttttaactagcacccaaagtgattcttgtgcaagtggttaatcaccaaacatttgagaaacatcaacagaattagagtccccaaactcaacaaacagaagaacttaaggaaacataattagtataattaatattctaaaagagattcaaatgtttatcatagctataagaacagccaggccaggcgcggtggctcatgcctgtaatcctagcacttttggaggctgaggtgggtggatcacgaggtcaggagtccaagaccagcctggccaagatggtgaaaccacgtctctactaaaaacacacacacaaaaaaaattagctgggcctggtggcaggcgcctgtaatctcagctactcgggaagctgaggcagagacttgcttgaacccaggaggcagaggttgcagtgagccgagatcgtgccactgcactccagcctgggtgacagagcaagactctgtctcaaaaaaaaaaaaaaaaatagccacagaaaacaccactggtattcttggaaatttaaaatggtattgcaaaaataaaaactagacagttgaagacttaaagagcggaatgaaaatagctaacatcaaaatcagtgaccagaaaagaaagccaaaaattctcacagaatgaaaaggatatgcaaagtatgagacaaaaattaaaagccacaagactcatccagacagaccaacattcatcttaataagagttttagaagagaaaagaaaatgtgtctctgcctagaaaagcgtctggaaaatatataccaagtccttaattgcagttatcactggcaataagaattgaattgaggtgaagtgaaaagagacattaacttttttcttaatttccataattgtataattattttacaagaataaattcatgtattccttatgaaattaattaatctagacatgaataaaattattgtcaaagatacaccaggaaaatgctaataaaaaggaagccaagaatatcaatattaataccagacaaattgaatcagagtagacactattaaaataaagaggaacattttataataataaaaggtaccttccaccaggaagtcataggagtcaagaaaacttctaaatctaataatataagggtattgttattttttgttgttgttgttgttgttgttaagacagagtctcactctgtcaccaggctggagtccagtggcacgattttggctcactgcaacctctgcctcctgagttccagagattatcttgcctcagcttcccaagtagctggttttacaggcacacgccaccgtgtccagctaatttttgtatttttagtagagacggggtttcactatgttggccaggctggtctcgacctcctaacctcaggtgatccacccgccttggcctcacaaagtgctgggattataagcatgagccaccgcacgggcctaatataagtttttaaatgtatggaacaaaataccactagaaatacaaggagaaaatggtattttgctgtaatgtgaaagacttcaactaacctctctcaaacaggtgaaacagaaaacagaagtaagaatgaagacactttatttattacaattacgaacttttaaaacttcctcccaaagagagaatacacaattttttcaaatatgtataaatacaactttcaaaacatgaattaagccacaaaaaatttcagtgttcccccaaaaaaattccaaacattttccaaaataaaacctatattttctgaccaaaattcagtaaaactagaaattaattttaaaggatgacaaaaataaacaaaaaacaattttaaaacaccaaaaaccaattttaacatttttaaaacacacttctagtagtataaggcaaagaaaaaaaaactaagttaaaactaacacctattttttaaaatacagataaaagtactgcttattaaacataggtgttcagaggaaaactgacaccatgaatgagtttacaaaagaaaaaaaccaagtaagaaaaacagaaaaagagagactaaaaattaactcaataaatatattcaagatattataaaagatcagcaaattaacctaagaaattagaaaatataagttaataaaaataaaagcaggccaggcacggtggctcaagcctgtaatcccagcactttgggagagcaaagcaggcagatcacaaggtcgggagatcgacaccatcctggctaacatggtaaaaccctgtctctactaaaaatacaaaaaattagccaggcatgatggcatgcacctgtagtcccagctactctggaggctgaggcaggagaattgcttgaacctgggaggcagagattgcagtgagctgagattgtgtcactgcactccaggccaggtgacagactgagactccatctcaaaataaaaataaaaataaaagcagaatctagtaaataattaaatagtagtcttaattgctaaaaagaaaattctttacagagaagaaaataaaaattcagatttttaaaattcaaactaaaaaaaagaagacacatgttcctaatgtcattcatctattgcctcttttttgtacacatctgtggaatacaacctgatgctttgatatatgtatgcactgaggaatgactgaatcaagctaattaacatgtccatcatcccacatacttttttgtggtgactcttttattgaggttttctttgcagcctttgctccatttttgtggatccattttggatccatttttccatagctatttgaaagatatgcgtcctctgttgcatgtgaagttctatacatgaaatcaactttccatactgcatatgggggggggctcaataaaaaataataaataaaaataaaaactgttctattttgaggtcctctataaatttcaatcagtagtcagtgtgaattatccactcctattacacaatcccttcatcagctctcatatttatttttccttcatgccttttctcattttgcagtgctcacaagtatggtccctagttaacgctaaactaaccctaaaactaaacatcatcaaggaatcggcatccaagaaagcccgacctgtgtcatgtgagtgaggatctaaaggaagagttgtgctagcttttattgcttgatttatggtattcttatctcctgaatatgcaatttttaggattggaggctttttatttttacttattttctagctcccattaagcacatgacaatgtggaaatagagaacaagtacctaataaatactgatgattaactgatggtcatgagactcatgatacaaacattttataagaatttgtttttaaaaacttgctgtggattcattttggttttttcaagttttggagaaaaaaaaaaaaacattactataactggctgccagagttttctccaagcttgacatcgggtccatataacagcaaaccttgaacacgatctataatgccatgtacatcatggggtctaagagtcccaagaagccaagagcaaacaaggtctaatactcattactatccatgtgttttatttaatcatcaagataaaggagatgttgtccttcttttattgggtaaatatttattagatgcattaaaacctcacactaggttctgaaatatcaacaattcattgctttttcaataaatatgtttaaagcaattactatgtacctggcaacttgctaggcggtgacaatataaatatgaataaggcattattcctctactcatataattcatccaatagcaaagacagatgcataaacaaataaatgtattaaactcaagacctaattgtattccaacagtctccatcatttgtcacaagagcattatttggaaagagtaattgttgggagggctcacgaaatatgtgttcaagttataactcttctaattcctgtttatttgactttgtacaagttacacaacctcacagaagagtagtttgctcctctataaagtacacaataactcctgacctatgtgctctatgaagcaatttgatactattaataaaatgtgcagataaacaccctaaatagtacaaatgtaagatgctagtaccttaaatttgtattaagccagtacctagcacaagggttcacacagacattaattacacagaaaatagatttaataaatatttgttaaatataaacagtacattgttgtagcacttattctcagatttaccacccattttaacacactttattcaatttcattattaactacctcaaacataagagaatgtatgaataaagaataataatataacacacattcatctaccaacccagcttctgaaaaacaatatgctcagtagctttaaagctcctgatgtgtgtatgcaacctctttctccccactcctccactcctcaatattgcataaatcattctcttccttctctttatatcttaccagacatgtctgtaacactagaaatgtgttgtttagttttgcttgtgtgagcctttatataaaagtaaaaatgctgtatgaattcttatacggcttgctcttttatggtaaagctttttgttttggtatcattcatattgacatgtattactataatttactcatttttattcattatggcctcatgtctaagtttaaagggagtgtttttaattactcaaatttaactatgaagtttactgtagaattttacagaaaccctttatcaagaaaactcacttctgttcctagctttctagaagttttaaataaattatattgaatttttcaaatgttttctgtatctactgagattattatatagtttttctcttctaacttgttaatgaggtgaataccatcagtaaatgttctaatgttgaactaacattacattcctggaataaattcaactttgtcataatgacttttttatctagtgctaaacagtttattcacattttgtttgcaatttttgcatctaatttcataaattagattggcatgtgaatttccttacttatctgacctgtgtagcatcgtttcacacttgcttcaccaatttcatataatggattgagagctactttgtttgtttgtttgtttgctattctcaggacactgctgtagaaatacatttacatattcctggaagggtttatagtattctatcaaactatctgagcctcctatttgctttcagtaaaaactgttaactactaattctatttaattatttcattcagattgtctatacttgagtcaattttgttaatttatattttcttaggaatttttccatttcatccaaattttcatttttatcagtataaatttgtttataatattcttttagtgttttagtatttataatatttagtatttagtcataaccctgtagttatgactcctcttctgactttcactcttacatgctgttttttgtctgctttcagtattcttaatttatctcaccagcagtttgtcaattttattggtctttacaaataatacacttttggctttgttgaacttctctactgtatctttgtttgtgatttaattaatttctattcttatctttattaattttttccttctgggttttttatattgtctgtttcaaactccaagtggaaacttagctccttaacatccagctttcttctttcctaatataagcatgtataggtgagaaatttccttctatgtactccctttagctatatcgctcaagttttgttgttattatacattatcattatttctcagttataagtattttttactttcaattataatttattcatgacccagtagttatacagatatggttttcaaaaaagattccaaatagtagggtaatttcacttatttacctaaatacatttctaggtggcctgtataatactagtgctttgaaaatcatgactcagtatgctgtcaatttttgttaattttccatgtgtcctcgaaaagaatgtgttacaacctcctggtgaatttatcctatcagtagatagtaactgtcattagcatttttactagtattgatatagctataccagctttcttcagttagaatttgttggatatcgttttatcctttgactttcaaactatcttgattcttaagtgttagatgtgtttttataaacagcatatagctagatttcgttttatattctaagctgtcagtcttttgtctttggagagtttaggtttcctttttacatttattatgattccaagattatttggatttattttattatgttttctactgtgtgtacatccttctttttccacagtgttttttcctccatttttttcttcttttggacaaactgagtttcttattttctcattgcatttctccttttccatatttggcaattatacagtctatgactacacatttttagtagttactatagacattttaacatgcttattaagataaatgcctaatataagtcaatatttttatccttccccaaaaaatatataaagaccctagaacatttaactatgattctatccatcctaattatacactgtgtttccagacacaatcattctacaattttaattatacaaagtatacatagttattaatcatttataaaaagtaatatgtaagcagtaataaatccttatgtttaccatttcctctgcttacaaattcttgcatttgcacccttaagataggataatttttttatttttctttaacaatttcttcagtgaaaagttgttgacaataaactattcatgtttgggactgggtaaaaatatatttatcttttttcttgaaaaacagctgtatcatgtattgaactcaaggttaacagttattttctctgagaatgatttactatcttgtaacattcatgtttaagaactcggctatcattcacagataatcagtcatcattcataggtaactcttttttttcctattttcttttaaaaatattcttttggtctttggcgttcttcagtttcactatgatacgtgtaaatataggtttctttaaagacaccttgcttgggatttactgggcttcttagctatagagaatggtgacttccatcagttctaggaaattctcattatctgttttatacttctctctcttctgaattgtatattataatattttagaacttgtcatggcatgtatcttaactgcttttcaaaaaatactttttacttctgtgtctttctgtgggaaactcaaagtaacctcttcaaatatctttcagatcaccaattctctaacctaatcacctgttttgcctaaccattgaatttttcatcattatatttttcattttagatagctctgcctggtcaattttgacagtcttttgtttcttcaacatattcattagggaataatgtatattaaaatacttttttcagtaccttataatttcaatatctacagtgtttgcagacctgattctgtagtttgttcattctatgaagttactcaagatggcttatttgtgtgtcttgtgaaaaccatcttccttggaaccgtatgagaattttttgaaagctgtgtataaagtgcagaaagaatctgagtttccttctggcagatctctggaggtattgccaggataaggcaattttaaactagatttttggatggggttttagaggctacacagataatatgaatgctgacccaaagtccagataaggacaggcctatggctagaaaattccaacatggattctgttccttttttctgagcttcccagagccaaggctatgctagtcaaaagttctcccaacatctcctgctattcgggttagtgttattttcatttctccaacaaggtggtcaaattttaaagattcccagtaacatgcaaatgtatcttacgggactttccagttggcaggatacagaatttatcttttgtcttcagttcacagtctttcaagattcaagctccaggccataattgaaaagcagctaccccatcccccagcataatgctggtgttggctcactagtttggattttgtgctttttgtatcagcctcaaataatttccataattcagttatcagattatttatgtatataaaaatattttcttcatctcttttagttcttatagttcactatatatctagaaaccaaaccattttttaaaatcatattaatgtgcttctagataacagtgatatctatttcttctttagcttctaaatgctaatctgactaacagagatcctgttttctcctaacaggtgaaaatgtaagaacatgaggagtatcttccccaaaattattacccttagtaaaagacagagtatcttggaagtaacagggaactctgactaaggctggacagctgctgagagaagagaatatatataaagttttttctctttgtgctgccttaccacagaaaggattctgagcagtgtatcacttacatgtgcttctggtagtttccatcactataaattcatggcctggttaaaagttaaagtagagccatatacccccaaatacatccactttcagtcggaggaaggagaaaaaaataagggtaaggaaaaaatgcttttcactgcaaaatcacaaaatggcatgccgtattattgcattcattcattcatgcattcattgatatttacctagcacttactacatttagggcattattctaggtgctggagatataacagtaaacaatgactgtatgaatgatgatacatgaatatgtaaaaaagttaaaaaaagtgaatatgacagctctctaaaaataagaaaatatacatacatatcatttgttatcatctttattgcatgggaattcagattagttcttgtgtaccacaatgacaacagctgctttttccctcctcacaggagacaatatgtcttaatggacttggaattttcaaagcaatttttattggtgaagtttcttgcttcataacattttcaaaattctcttaatctacaattcagcacttctcagctctcattcagccacaaatacagaagaaaacccctataattcacactggcctttccaataaatcaattgatttagccagtatagtgttccaattcaacttctattttctccactcataaatttcaggtttcatactcacacccagccaagggccagaatgaaaaatttaacaaaagcttcagcatggttgttgagtaagcactctgatacattccacactataaacatttaatgagacttactcccaacagagtatttactacatcaatttacttcatagtattatatttgcaggagcaaaatagagcaaaggttattttggatcctttaccaatacagcttcctgtaaataatgaaaagtgcaaccatttaatttaccaaatcattaaaaaaggttaaatgctcaataaattctgctttatctagttcagtcagccacagcagctatttgtaacttggatataaaaaatatagaaaacttaggcattttttactagtttgtgcatctgtacctttgactagaactaaatttcaaaggttgttcagacagtttagaatcctcattaggatctcagagaaatatcttttggaccccttcccgcctcatgaagaacaactgagtctgcctttcttaagagaacactgttgccctgcctatgcccactcccactgaagttacacacataacacgcacactttctcctcctctccaaccactgccattttgtgcctgtggcagtcactttcaactaaaaagagaaaagagaagaggtctcagaaggaggaacaatttggaaatgtcttcttctttaatcctaaaatacagaatgcattgtctgagataaactggagctcttatgggagcattctctgacacaattgtgttttagtactgtgaaaaatgtgctatacaggttgagcgttgctaatctaaaaatctgaaatccaaaatgctccaaaatctaaaactttctgaatgccaatgtgatggcactagggaaaaattcagcatctaacttcatgtgacaggtcgcagttaaaatgcagtcaaaacatcatttcatgcacaaaatttttaaaatgttgtataaaattaccttcaggctatgtgtatagggtatatatgaaatataaatgaatttcatgtttacacatcaatcccattcccaagataattcattaggtatatgcaaatattccaaaatccaaaaaattccaaaatccaaaccacttctggtcccaagcatttcagataagggatgctcaacccgtatgatcctatctatctactctaacaaatttcaatgtatcacactcggcactccccagatacagactacagatggtccctgacttgatttaacaatggttcaacttataattttttccagctttatcatggtgcaaaagtaatacatattcagtgtgtatatagagtgtttcaggcccctaaaggtcatacccttcccagggtagagtaacctgcatccagtgactgaaagagacatacaggcctggccatttctgcctgacaaggtacactctggagggcaatgctctcaccagagctccctgctgattggcctaggctttgcgggtctagctgtcaggtagacttcttcctctatccagtcccgctccttccctctttccttcccaaatgtaacaccttgttttccaaactccattctgtgtgtgattctggaggacccagcctacaacactagccatgactccttcctttcattcatgtcccacatccattctatcaaaattcagttgactctatttacaaaatttagcactgatgtccaccaacaccactctagtctaaactaaaacatgaggtggttcatgtaaagtgtataaatggaacctgggttactacaatagcctccagcctggtttttcagttcctctcattgttctccttcagtctatgttccttatgcaactatcatagtccttttaagacacgagtcgcagcatgtcacacctttgcttaaaacctttcagtgtattcccatttaacttggagtaaaagccaaagtccttaaaggcatacacactcctaaatggttggttctccaaccttagctcctgctactcatcactttgctgtcttcacctagacaccctggtttttatgttgtcacttaaacacagggcacataccttcaagcctttgctctagatcttcatctgcccgattcctgaactctttcaaggctttggcattatctcaccttctcagtgtaacatctatacaattttgttctctacagtgtttattggttttattttttgcctataatcacctgctaaaatgtaaaaatttgtcaagggaagtgatcagatatgtcccaagcacatagaacagtaatgccaataagtatttgtggagtgaataaatcttatgcttcataagtagatctacataaaacaaagtcatcatttcgatctaattaacaatcccacttcaaattcattggattccttggcagagatgtacaggagtcagaagtttactaacagagtactttcctgttaatcaattctttggaagactcaagaaggtgatagagactaatctggattttttattttctcatgctctaaacgccaacatgtggatcttcttctgttttattattattattactgtattaggacatcagatcacactttatctttctcccgacttacctccagctcatcaagggcacttcccagggttgctgcctgaggttctggtggggttgtcatattctggatcccttgtgaagcatttgaaattacattgagagcattctgaatttcttcacaaactgtgtccttgcttgctttgagggaagcaacatcagaatgctccaaacaagctgaacaaattgaatgcaagaggggagagttctccttcagtgaagctcgggctcctgcaatttcatctctctgatttggagattttaagtcctgagaaggtaaataaaaagagtggtatcttacaatgggttatgggagaaagacttaaattaaaaagcttctttttttgtaagtataaatgaaaagataatagacatgaagaagtcagctataagttataatcaagggcatctattatttctacattctttcagtttctgttaaaaattctgcagtataaacaatgacacagttaataagtaaaggtccccgtagagcagatgtgtaaagatccattactattcagtcaagtccttgtcagtcaaatccttataagtagctaaaatactctggcattcacattattaagtgcattacatgggagcttgaattacaaggatgctgattacctcattccatagatgttgataattgcatttaacctctccgttaaaattagaccaattgagttaagaacactaatgaaacctcccaccattcagctatttttctttttcagaaatactaataaattaatcctatatcattctttctttgatatttattcaacaattagttactgagcacttagcatattctagcccttgtgctggactccagtgtacagatatgaaaaaatcctacaaggaccttgttcttctttcttttggggggaaagggcctacagacaaacaatgaactagatgaacaaatatacgagatgatttcaggtgacaataaatgctatgaagaaaacacaaaagtgaagtgtcatagagattgacttgaaaggaaaagctgctttaggctgaatggtccgagaaggtatttcttcagagatgacaatttgcagtaaatgtaaatgaatagcattacatcagagagaagagaggaaagagaatgccctgtctaagtgataggcgatcagaactagctcaatatacaagaaaaaaatctggcaagccctaccttaaccaagtgatgaaatttaacataatcagtgatatcacatggatatcatgtaccccttgatatactgtgacaggaaaagtatgccatttctgtggtattccctccaggaacccataattccagtctaatcatgagaaaagcaacaaacaaaatgagattggtgaacatcctaaatgacacctgggcagtattcctcaagaccattaacatcatggaaaacaggagatggactgacaagctgtcacagaacagagaagattggggagacataactaaatgcagtgtggtactgaggattagatcctggaacagaaaaaacattcatgaaaaactgctgaaatccaaataaccattattaatagttaatagcaatgcatcagtatccatttctttgtagtggcaaatgtaagatacagcattaacaatggagaaaactggaaaaaaggtaaatgggaactctctgtaccacctttgcaacttttctgtaaatctaaaattactcccaaataaaagcttaagttaaaaaaaactaattcaagggacatttacaatagttcattcacttcatatacaacatttcatataatctttataaaaactcatgagagatgtgattattcccattttaaaactcaaaacactaaggtttcaagagactaagtttcttagccaagtggcagagctagatggtggtatttcttgtattgtaacccacgtcagtataacttccaagcccttatcctaaaaactatgtgacattatttcctacataggaaaaatttttttcttttttctttttttatgacagagtcgcgctctgtcgccgaggctggagtacagtggcgcgatctaggctcactgcaagctccgcctcctgggtttatgcagttctcctgcctcggcctcctgagtagctgagactacaggcacccaccaccacacccagctaattttttgtatttttaatagggacggggtttcatcatgctagccaggatggtctcgatcttctgaccttgtgatccgcccgcctcggcctcccaaagtggaaaaatttcttatttgctacacagaatgaggacttgtatttgtataatatcatgtagcttataaagtgcttctatacagtatcttactgatcatgacaatagtctttgagggaatgaggctgctattattagtcctattttaactaaacaggtgtttggtgcaaggagatagaaactagtaaaggaacagagatctaaacctaagtctactgattgctaaccttatgccttttcacaagactctgctactctgggaataatgttgcatgaggttaataaatggcttgtgctactatatttttagttccttcccttctgaaaataaacactgtctgctacttcactcaggctttggagagattaacttcgttacaaaatgtagggaggacagttagaagtagctatcaacccactgttcatagtcactaatcacccaagaaaagacactatggttttcttggcttgctacgatttcccccttgtatatgtggtctgggttttagttttagttctgtcattagcactgtgagctaggtaactcatctctttcggtgtctgtctttctatctgtaaaaatgggataatgatacttctgccgaccctctcacaagattgagtacatagcacatcagaaatggaatataagtggaaaatagagaaaaggtgtagaaagaatacggaattgttttattccttacatctgtcaaacttggtgtactgtttctgtactgataatcttagtgatttttgtatttcccacaacgttgtacaagctctacctacagtcatcagtgtaacttagaggataaatagtttaatgtttagaaaggatgcacagctcctcagatgagtaataattaaaagtataaatatttagaaaaaggtaaggcaaattctctgatattactgtacaatcacaacttaatacataattctctctgaagtgacctatacattatgcttctttatttagaaggacagtgtcaaggtttagtttgtttctgaaaggtgaaaaacttgaacatagattataatcaagaagctaaagttaaaattatttcttttgctctaatggtagcaatgtgtaatctgatggtaaattgtagtaactttaatgccatggggactttgaaatgttaaaaatacaaatgtattttgaatttggagcctatgctttgtcatctctgcccaaggcaattacagaatccatgagcccaaatagcaagtccttgacgcctgcgaaaaaggactagatcagtgaacataacaaatataacgttacagcagtggacaggggcaaaggggcaggtggcagagtttatgtaaggaaaactgacaaggcatgaccatttctcccaaaggacatcaagcatgataaacttaatgtagtaaataggcacacagataaaagagaaattaatgactgtcacctcctaaatgtatgttgtggtagtggtgtttgtagttgttttattttaactgatgataccataggttcaaaggttcttgtttgtccatttaccctaaaattttacataaagtcaaaataggcattaaacagtaaagttaatcagggatttctttggatggagaagtataaagaattcagctcctcaaggattgatacttatttataatctttttttaaatgctccagaagaaagctcacaggagatttccaagttaagaagacattaaatgtttccagctgacgaagaaacacacagatgggatttaaaaagaccttaaagtctgtgcaagtgggtagagaagtaacatatgagttttaaccctggcaagagaacaaaatatatttaggaatattattttaaaaaatacaagtggagggctttaagctatcagttaattaattcaaccattccttcaacctgtactatgttgagcctctcctatgctgagcctcgactttgcatcaaggcagtgtgctaaatgttggaaatgcaaagataaagatcaggaggggagacaaataaacacatttacatgggaactaaaatagagttacccacagcatagaggacagtctctcagtttgaagggattaaataaaatttctcagagaatgtgaatcttttttccagctttattgaggtacaattaacaaataaaaattgtgtagattcaaggtgtactatatgatgctttcatatacatatacattgtgtaatgattactacaatcatattaatcaatatatccatcaccacacagttaccctttgcgtttgtgtgtatgtgctgtgagaacatgtaagatctattctcttagcaaatttcaagtaagcaatacattattattaactgtcttcaccatgctgtgagttaggtccctagaacttactcatcttataattgaaagtgtataccctttgaccaatatgtccccgtttcccccacatgccaacccctggcaactatggtaaaactgcttctatgagtttgacttgtttagattccacatataaatacaatcatacaatatttatctttctgtgccgggcttatttgacttagcataatgtccttcaggttcatccaagttgtcataagtggtgggatttcagagaaggtgaatcttaaacagtgagtagaagttatccctatgagggaggacccacagaccctttgaaggaagcggactgctcctgcaaaatctgggagacaccacaaatactgtgagtgccccaactgcggaagtgggaaagggagagcctcctctcctgaatacacaaccccactggggcaaatgaaggtctgtttgcgggagaagtttctgaccttacctggagctgagtcaatttaaagagccaagcaaaaaaaaatatagagaggaagcagcagaaagtccctaggagctcgctgggtccccagtcaggccattcctgcctggcatcacagggatccactgggagggcagccagagaagcaggggttgggggagggggaagcaccacagggagaaggaaaattccagctgaacttcgtaacaatttgaacagggtgagaagcctcatggccagaacttgagggagggtgtgaatccagcatgcagactccacagcgtgggggaagaaccaggccgttttcatttgaaggtggcaggcaggtagcctggggcaagttctcaagcccagcttgcccaccacctggaaacagacttggggctgtttgggggcacggtgggagtgagaccagccctttggtttgcctgggagctgggtgaggcctgtgatggccagctttcccccacttccctgacaacctggatgactcaggagaggcagccataatcttcttaggtgcacaactccattgacctgggaatctcactcccaccccctacagcagccacagcaagacccacccaaggacagtctcagctcagacacgcctagctctgtccctatttgatggtccttccctatccaccctggtagctgaagacaaagggcatataatcttggtagttctaggacctgcacgctgccagttcctctccatactaccacagctgatgctctctacaaaaccccatctcctggcaggaggccaaccagcacaaaaatagagcattaaaccaccaaagctaagaaccctcacggagtccactgcaccccgctgccacctccaccagaacaggaactggtatccacagctgagagagccatatatggttcacatcacaggactctgtgcagataacccacagtaccaacccagagcagggtagacttgctgggtggctagacccagaagagagacaacagtcattgcagttcggctcacaggaagccacacccataggaaaagcgggagagtactacatcaagggaacaccccttgggacaaaagaatctgaaaaacagccttcagccctagaccttccctctaacagagcctacacaaataagaaggaaccagaaaaaaaaatctggtaatatgacaaaacaaggctctttagcacccccaaaaagcacactacctcaccagcaatggatccaaaccaagaagaaatccctgttttacctgaaaaagaattcaggaggttagttattaagctaatcagggagggaccagagaaaggtgaaacctaatgcaaggaaatccaaaaaacaatacaagaagtgaagggagaaatattcaaggagatagatagcttaaagaaaaaacaaccacaaattcaggaaacattggacacactttagtaatgcaagaagctctggaaagtctcaggaatagaactgaacaagtagaagaaagaaatccagagctcaaagacaggtcttcaaattaacccaatccaacaaagacaaagaaaaaagaataagaaaatatgaacaaagcctccaagaagtctaggattatgttaaacgaccaaacctaagaataattgatgttctggaggaaggggagaatcctaaaaccttggaaaacatatttaggggaataatcaaggaaaacttccccagccttgctagagacctagacatccaattacaagaaacacaaagaacacctggaaaattcagcctgaacagatcgtctcctagacacattgtcatcaggttatccgaagttaagatgaaggaaagaatcttaagagctgtgagacagaagcaccaggtaacctacaaaggaaaacctgtcatattaacagcagatttctcaccagaaaccctacaagtaagaagcaattgggaccctatcttcagccttgtcaaacaaaacaattatcagccaagaattttgtatccagtgaaactaagcatcatatatgaaggaaagatacagtctttttcagacaaacaaatgctaagagaatttaccattaccaagccaccactacaacaactgctaataagaagctctaaaccttgaaacaaatcctagaaacacatcaaaacagaacctctttaaagcagaaatcatacaggacctataaaacaaaactacaagttaaaaagcaaaaacaaaaaaccaaagtacatagacaacaaagagcatgatgaatgcaatggtacctcacatctcaatactaacacagaatgtaaatggcttaaatgctcgacttaaaagatacagaaccacagaatgcagaagaactcaccaaccaaccatctgctgccttcagaagactcacctaacatgtaaagactcacataaacttaaaggggtggaaaaaggtatttcatgcaaatggacaccaaaagcaagcaaaggtagctttttttttcttttttttttttttgagatggagttttgctcttgttgcccaggatggagtgcaatggcgcaatctcagctcaccacaacctctgcctcccagtttcaagcgattctcctgcctcagcctcccaagtagctaggattacatgcctgcaccaccatgcccggctaattttgtatttttagtagagccagggtttctccatgttggtcaggttggtcttgaactcccaacctcaggtgatctgcccgccttggcctcccaaagtgctgggattaaaggcctgagccaccatgcctggccaaaggggtagctattcttatatcagacaaaacaaacttaaagcaacagcagccaaaagagacaaagagggacattatataatgataaaaggccttgtccaacaggacaatatcacaatcctaaacatatatgcaacactggagctcccaaatttataaaacaattactaatagatctacgcaatgagatagcaacacaataatagtgggggacttcaatactctactgacagcactagacaagtcatcaagacaaaaagtcaacaaaggaacaattgatttaaattataccttggaacaaatgaacttaacagatatatacagaacatttcatccaacaaccacaaaatacacattttattcaacagcacatggaactttctccaagacagactatatgataggccataaaatgagcctcaataaatttaagaaaattgaaattatatcaagcactctctcagaccacagtgggaaaaaaactggaaatcaactccaaaaggaaccttcaaaaccatgcaaacacatggaaattaaataacgtgctcctgaattagcattgggtcaaaaatgaaatcaagatggaaatttaaaaattcttcgaactgaacaaaaacctctgggatacagcaaaggcggtgctaagaggaaagttcacagccctaaacacctacaccaaaaagactgaaaaagcacaaactgacactctacggctatacctcaaggaactagagaaacaagaacaaaccaaacccaaacccagcagaagaaaggaaataaccaagatcagagcagaactaaatgaaatcgaaacaaaatgaaaacagatgataaatgaaacaaaaagttagtttttttgaaaagataaataaaattggttagcaagactaaccaagaaaagacaagcgaaaatccaaataacctcattaagaaacaggagataggccaagcacagtggctcacgccggtaatcccagcactttgggagactgaggcgggcagattacaaggtcaggagtttgagaccagtttggccaacatggtaaaaccccatctctaccaaaaatacaaaaattagcagggcgtggtggcaggcacctgtaatcccagctacttgggaggctgaggcaggagaatcgcttgaaaccggaaggtggaagttgcagtgggctgagatcgtgccactgcactccagcctgggcaacaagagtgaaactccatctcaaaaaaaaaatagaaagaaacaggagatattacaactgataccactgaaatacaaaagatcattcaaggctactgtgaacacctttatgcagataaactagaaacctagaaaagatggataaattcctggaaaaatacaaccctcctagcttaaatcggtaagaattagataccctgaacagaccaataacaagcagcgagattgaaatagtaattaataaattaccaacaaaaaaatccaggaccagatggactcacagcagaattcttccagacattcaaagaattagtaccaacccttttgacactattccacaagatagagaaagaaggaaccctccctaattcactctatgaagccagcatcaccctagcaccagaaccaggaaaggacataaacaaaaaagaaaattatggaccgagatccctgatgaatatagatgctaaaatccttaacaaaatactggctaactgaaaccaaaaacatatcaaaaagataatccaccatgctcaagtgggtttcataccagggatgcagggatggtttaacatatgcaagtcaataaatgtgatacaccacataaacagaattaaaaacaaaaatcacatgatcatctcaatagatgcagaaaaagcatttgacaaaatccaggatccatttataattaaaatatcaggaaaatcggcatacaagggacatacctcaatggaataaaagccatctatgataaacccacagtcaacattatactgaatggggaaaagttgaaagcattccctctgagaactggaacaagacaaggatggccattctcaccactcctctgcaacatagtactggaagtcctagccagagcaatcagacaagagaaagaaataaagggcatccaaattggtaaagaggaagtcaagctgtcactatttactgatgatatgatcgtttaccttgaaaaccctaaatactcctccagaaaggtcctagaacgatacaagaattcagcaaattttccagataaaagattaatatacacaaatcagtagctcttctatacaccaacagtgaccaagtggagaatcaaatcaagaactcaacaccttttacaattgctgcaaaaaataaaataaaataaaatacctaggaatatacctaacaaaggagtcgaaagacctctacaaggaaaactacaaaacactgctgaaagaaatcacagacaaaacaaatggaaacacatcccatgctcatggatgggtagaatcaatattgtgaaaataaccatgctgccaaaagcaatctacaaatttaatgcaatccccatcaaaatactaccatcattcttcacaggattagaaaaagcaattctaaaattcatatggaaccaaaaaagaacctgcatagccaaagcaagactaagcaaaaagaacaaatctggaggtatcacaccacctgatttcaaactatactataaggccatagacatgaaaacagagtggtactggtataaaaataggcacatagaccaatggaacagaatagagaacccagaaataaacccaaatacttaaagccaactcatctttcacaaagcaaacaaaaacacaaagtgaggaaaggacacccttttcaacaaatggtgctgggataactgactagccacatgcaggagaatgaaactgaatcctcatctctcaccttatacaaaaatcaactcaagatggattaaggacttaaatctaagacctgaaattataaaaactctatacgataacattggcttaggcaaagatttcatcaccaagaacccaaaagcaaatacaaagataaacagttgggacttaattaaactaaagagcttttgcatggcaaaaggaacagtgagcagaataaacagacaatccacagaatgggagaaaatcttcacaatccgtaatctgacaaaggactaatatccagaatctacaatgaactcaaacaaatcaataagaaaaaaacaaaaatcccatcaaaaagtgggctaaggacatgaatagacaatgctcaaaagaagatatacagagaagccaagatagctgaataggaacagctcggtctacagctcccagcttgagcgacgcagaagacaggtgatttctgcatttccatctgaggtacagggttcatctcactagggaataccagacactgggcgcaggtcagtgtgtgcacacaccgtgcgcgagccgaagcagggtgaggcattgcctcactcgggaagcgcagggggtcagggagttccctttcctagtcaaagagaggggtgacagaccgcacctggaagatcgggtcactcccacccgaatactgcgcttttccgacgggcttaaaaaacggcgcaccaggagactgtgtcccgcacctggctgggagggtcctacgcccaccgagtctcgctgattgctagcacagcagtctgagatcaaactgcaaggcggcagcgaggctgggggaggggcgcccgccattgcccaggcctgcttaggtaaacaaagcagctgggaagctcaaactgggtggagcccaccacagctcaaggaggcctgcctgcctctgtaggctccacctctgggggcagcgcacagacaaacagaaagacagcagtaacctctgcagacttaaatgtccctgtctgacagctttgaagagagcagtggttctcccagcacgcagctggagatctgagaaccagcagactgcctcctcaagtgggtccctcacccttgaccccagagcagcctaactgggaggcaacccctagcaggggcagactgacacctcacagggccgggtactccaacagacctgcagctgagggtcctgtctgttagaaggaaaactaacaaacagaaaggacatccacaccaaaaacccatctgtacatgaccatcatcaaagaccagaagtagataaaaccacaaagatgtggaaaaaacagagcagaaaaattggaaactctaaaaagcagagcacctctcctcctccaaaggaacacagttcctcaccagcaacagaacaaagctggacggagaatgagagaagaaggcttcagacgatcaacttactccgagctacaggaggacattcaaaccaaaggcaaagaagttgaaaactttgaaaaaaatttagaagaatgtataaccacaagaaccaatacagagaagtgcttaaaggagttgatggagctgaaaaccaaggctcaagaactacgtgaagaatgcagaagcctcaggagccgatgcgatcaactggaagaaagggtatcagcaatggaagatgaaatgaatgaaatgaagtgagaagggaagtttagacaaaaaagaataaaaagaaacgagcaaagcctccaagaaatatgggactatgtgaaaagaccaaatctacgtctgattggtgtacctgaaagtgacggggagaatggaaccaagttggaaaacactctgcaggatattatccaggagaacttccccaatctagcaaggcaggccaacattcagattcaggaaatacagagaacgccacaaagacactcctcgagaagagcaactccaagacacataattgtcagattcaccaaagttaaaatgaaggaaaaaatgttaagggcagccagagacaaagcttgggttaccctcaaagggaagcccatcagactaacagcggatctctcagcagaaactctacaagccagaagagagtgggggccaatattcaacattcttaaagaaaagaattttcaacccagaatttcatatccagccaaactaagcttcataagtgaaggagaaataaaatactttacagagaagcaaatcctgagagattttgtcaccaccagacctgccctaaaagagctcctgaaggaagcactaaacatggaaggaacaactggtaccagccactgcaaaatcatgccaaaatgtaaagaccatcgagactaggaaaaaactgcatcaactaacgagcaaaataaccagctaacatcataatgacaggatcaaattcacacataacaatattaactttaaatgtaaatggactaaatgctccaattaaaagacacagactggcaaattggataaagaatcaagacccatcagtgtgctgtattcaggaaacccatctcacgtgcagagacacacataggctcaaaataaagggatggaggaagatctaccaagcaaatggaaaacaaaaaaaggcaggggttgcaatcctagtctctgataaaacagactttaaaccaacaaagatcaaaagagacaaagaaggccattacataacggtaaagggatcaattcaacaagaagagctaactatcctaaatatatatgcacccaatacaggagcacccagattcgtaaagcaagtcctgagtgacctacaaagagacttagactcccacacaataataatgcgagactttaacaccccactgtcaacattagacagatcaatgagacagaaagtcaacaaagatatccaggaattgaactcagctccgcaccaagcggacctaatagacatctacagaactctccaccccaaatcgacagaatatacatttttttcagcaccacaccacacctattccaaaattgaccacatacttggaagtaaagctctcctcagcaaatgtaaaagaacagaaattataacaaactatctctcagaccacagtgcaagcaaactagaactcaggattaagaatctcactcaaaaccactcaactacatggaaactgaacaacctgctcctgaatgactactgggtacataacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagacacacaaaaaacccttcaaaaaattaatgaatccaggagctggttttttgaaaggatcaacaaaattgatagaccgctagcaagactaataaagaaaaaaagagagaagaatcaaatagatgcaataaaaaatgataaaggggatatcatcactgatcccacagaaatagaaactaccatcagagaatactacaaacacctctacgctaataaactagaaaatctagaagaaacggataaattcctcgacacatacaccctcccaagactaaaccaggaagaagttgaatctctgaataggaccaataacaggagctgaaattgtggcaataatcaatagcttaccaaccaaaaagagtccaggaccagctggattcacagccgaattctacaagaggtacaaggaggaactggtaccattccttctgaaactattccaatcaatagaaaaagagggaatcctccctaactcattttatgaggccagcatcatcctgataccaaagccgggcagagacacaaccaaaagagagaattttagaccaatatccttgatgaacattgatgcaaaaatcctgaataaaatactgggaaaccaaatccagcagcacatcaaaaagcttatccaccatgatcaagtgggcttcatccctgggatgcaaagctggttcaatatacgcaaatcaataaatgtaatccagcatttaaacagaagcaaagacaaaaaccacatgattatctcaacagatgcagaaaaggcctttgacaaaattcaacaaccttcatgctaaaaactctcaataaattaggtattgatggggcgtatttcaaaataataagcactatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaagaaaagaggaagtcaaattgtccctgtttgcagatgacatgattgtatatctagaaaaccccattgtctcagcccagaatctccttaagctgataagcaacttcagcaaaatctcaggatacaaaatcaatgtacaaaaatcacaagcattcttatacaccaataacagacaaacagagagccaaatcatgagtgaactcccattcacaattgcttcaaagagaataaaatacctaggaatccaacttacaagggatgtgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttacagattcaatgccatccccatcaagctactaatgactttcttcacagaattggaaaaaactattttaaagttcaaatggaaccaaaaaagagcccgcatcgccaaggcaatcctaagccaaaagaacaaagctggaggcatcacactacctgacttcaaactatactacaaggctacagtaaccaaaacagcatggtactggtaccaaaacagagatatagatcaatggaacagaacagaaccctcagaaataatgccacatatctacaactatctgatctttgacaaacctgagaaaaacaaacaatggggaaagtattccctatttaataaatgctgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtttaaaacaccaaaagcaatggcaacaaaagccaaaattgacaaatgggatctaattaaactaaagagcttctgcacagcaaaagaaactaccatcagagtgaacaggcaacctacaaaatgggagaaaatttttgcaatctactcatctgacaaagggctaatatccagaatctacaatgaactcaaacacatttacaagaaaaaaacaaccccatcaaaaagtgggcgaaggacatgaacagactcttctcaaaagaagacatttatgcagccaaaaaacacatgaaaaaatgctcaccatcactggccatcagagaaatgcaaatcaaaaccacaatgagatatcatctcacaccagttagaatggcagtcattaaaaagtcaggaaacaacaggtgctggagaggatgtggagaaataggaacacttttacactgttggtgggactgtaaactagttcaaccattgtggaagtcactgtggcgattcctcagggatctagaactagaaataccatttgacccagccatcccattactgggtatatacccaaaggactataaatcatgctgctataaagacacatgcacaggtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagcaaactatcgcaagaagaaaaaacaaaacaccgcatattctcactcataggtgggaattgaacaatgagaacacatggacacaggaaggggaacatcacactctggggactgttgtggggtggggggggtggggagggatagcattgggagatatacctaatgctagatgacaagttagtgggtgtggcgcgccaacatggcacatgtatacatatgtaactaacctgcacattgtgcacatgtaccctaaaccttaaagtataataataataaataaaaaataaaaaaataaaaaaagaagatatacaaatggccaacaaacatatgaaaaaatgcacatcactaatgatcagggaaatgcaaatcaaaactacaaggcaataccaccttactcctgcaagaatagccataatcaaaaaataaataaaaaacagtagatgttggcatggatgcagtgatcagggaacatttctacactgctgatgggaatgtaaactagtacagccactatggaaaacagggtggatcttacttaaagagctaaaggtagaactaccatttgatccagcaatcccactactaggtatctaccccagaggaaaagaagtcattacatgaaaaagatacttacacacatatgtttacagcaggacaattcacaattggaaaattgtggaaccaacccaaatgcccatcaatcaatgagtggataaagaaactatggtgtatgtatatatatatatatatatatatatatatatatatatatatatatatacacacacaatggaatactactcagtcataaaaagaaatgaattaatagcatttgcagcgacctggatgagattggatactattattctaagtgaagtaactcaggaatggaaaaccaaacatcatgtgttctcactgatatgtgggagctaagctatgaggacacaaaggcataagaatgatataatggactttggggacttggggtggggaggtgtggaattgggggaagggataaaagactataaatatggcgcagtgtataccgctcagatgatgggtgcaccaaaattttacaagtcaccaccaaagaacttactctagtaaccaaataccacctattccccaataacttatggaaatttttttaaaaaattaaaattaaaaaattcaaacattgcctaagtataatagaaaaaaaaagaagctatccctatgagcaatgcagaacaaaagagcatgtggaaaggtctgaagcatgaaaaggcgaggaaggtgcaggtcactgcaggtgatatgacaaatacaggaaacctaagcatgaatggtgatgaatccagcagaaaaaggtaggcaagagacatttcacgtgctctgctaaagaactctgaaagcaacaagctcagatgtgtatttacaaagattgctctggcaatgggtttttgagtggattggagagaatgaaattgcagtcagagagaccaggcaataacccaggtctgggaaagagacaataagtgcctgaacactattgctaggctatagtgggagagatccaggaaatttttaggaggtacaaatggtaggattttggtatatctagatgggagtagggaagagaagatatttgaaagcatctagagaattgtttcagcaatcgtggaagtggtgatgcattcaccacaatgagaatacagagagaagaatgtacttggaagaaaaaggtgaacacattttgtaatctgccaaatgtaatatatcagcacaagatccaaatgaaaatacaatacacatgaatctagacttcagaggagagtctgggccagaaatagagatatgtgaaacaccagctcacagttgggagctaaagccatgtgtgtgaaggctacaggacctgcatccagggtgaatattacaataaggagaagaatctaggagtcatcgtaaattgttccttgagtatatcaacccagtaattttatgtgctagcccaaaaggccaaatatatatttatattagcaagaagggtatcagcaaatactaaactaaaaaaaaaaaaattcaattaaaaatatttttaaataggccagaaaacgcatgcaggctacagagttagaatctaaactactgtgggtaatcatggtcatcataccttaagataacaaatgatttttctttaaaagcaattttgaacagaatgacttctgtttctggaaagcttaaaaatatgaggtctgttcaccttggaaaggggaaatttttattggaaaacgcatgataaaaacatctgtaaatcatgaacgaacttgataacttgttaatgggcttctttacttaaatctggagatactaggtcatagaagtagctttttagatttgagtaaaataaattatatctgttcatacttctgtcttcactacttcattataattctcttgaatgcaagtactatggcttacttattttatacctcattatctagtagtatacagcacatattaggagtttaatacatttttgttaaggaaacagacaaatgaataagaattaagccagaggaagtcaatatgctcaaaaggagatagaaactccagatatgattactccaagaaataaaacatggggaaaatataccttaatccagagagtttgaataaatttatgcatggcaatgccacagaaagctgaagagcaaaattaaactataactatcttcacattaaatggtagtgaggccgttggtacgactactttggaaaatgatttgatagtatttactgaagctgagtatatgcatgccctgttacccagctatttcattcctaggagaggatacacacatatggaaatatgttcctatgtccatctaaagacacaggcaaaaatgttccataccagcactgtctgtaatagtcccgacctggacacaacccagagtaatgaaaaagaaaaaaagacagctacacgtgataaaaaaaaaaaaaaagcaagacataaaagagtatgtatggtttaattccatctatgtgaagttcatactcaggcaaaagtaacctatcattttaaaaatcaaaatagtggttattctttggggggtgattagagactaaacagggaggaggaatctttcagtttctggtaattttctatttcttgtcctgggtgctagttacaccaatgtgtttagtttggaaaaattcattgaactgtttatttcacactatgcatttttctgaatgtatgttatactttaattaaaaaagcttcacataaaatcaaggaaatgaaaaacaaaaagtaaagccaatatctacagtgtgagccttcttttggcaaaggacactggtataaactagctatggactggctatgttgtcatattacccatgtcattaagggaagaatgagaaaattagatattctgtccatctgtaagaatcctgtatccactttgagggctcatatttttaaaaaagaaaaaaaagtctgaaatataaaaataagaagagaaagctcctgtagcctgaccatcagaaaaagcaaacctaagaggttttcacagcaactgattccatgaaccgttggacaaacctgcatttctgagaatcaaagaaaacttccttacgaagctacattcctgcccacatggaatagctcagcatatactctgctcaacaaagcagagctacatacaaattactgagtttctcttccaggtgtttaaatgaggtttctgaagctgacaaaaccactctggtaagggaaggaaagggagcttataaaaagaggttttgtttgtttgagattaagatgtgcagcagaaaagcccatgtatactttgctatttggattccattatgggttggcttctgtctccagtcttctctctgccaagatgctgcataccaattgcttcactggtcattgggcagcttcatgttctattaggaaacaaaataacacaaacacctgctaatttaatgttcttggccaacttaaattaggaaatggaaacttagtcttaactgagctgaaggatataagatggtgaaacaacagtaggcttcaggtaaaagaaagttttgagaagaaaaattaaaattaaaaaaatgcaagattttacaataaaagcatcattaaggagcagagagaggcctttactacttttctatccttatttcccatttgtcatttcatagaaataggacagattcaataaaagagaaaataaaagaattcttcaaattcaaataggaaactgagaaaccatatcataatagtattaagatatctcccaaggtgtgcattctgggccattaatgcataccttgggtaactgaaatacaccaaggtgaatattaactccaaagaaacctatgaggaaaacattatcacttaattctaatgcggactactgtgtcagtcaagaaaatgtaggggggtgtgtgtgcacatgtgtgtgtgtgtaaagttcaaaaatgcactatgttcatttcctgttcatctgaagcaaatacaatatgtattacatttgtctattgtttgcttagaatttatatctcaaaataaatggtatctgaagccatctgccgcatgattaaaaagtaaaaggaatacacagaaaaacaaaaaagttatgggctattttagcaaaattcagtggctgtacttaatgcatcctttccattggtgcatatgtttcatcatttaatctatcaagaagagtcaaatatccataggtcagggccaggggtgatggctcatgcctacaatcccagcactttggaaggccgaggcaggtggatcacctgaggtcaggagttcaagaccagcctggccaacatggtgaaaccccatctctactaaaaaaatacaaaaattagttgggcatggtggtgtgcaccagtaatcccagctactcgggaggctgaggcataagaatcacttgaaccttggagacagaggttgcagtgagccaagatcatgccactgccctctagcctaggtgacagagtgagactgtttcaaaaaaaaaaaaatccataggtcagaaaatttttcctctaaagcataattaacaattataaaagtaaagttgaattttttaatttagtcaaaaatcaataaatatttttatccttgcaattccttcctatttaagttttcttgtgagaaacagaccacttgtttcctgaacattatggtgcatctcaaagagcaaacagaatcacttagatcaaatagggtccaaagcccagggatgttgacccaacttcctagttaataattcattacatttgtgtagtgatttattctgttcaacatatttccagccattcttccacaaggagttctatgagaaatcataaaaagcggtatcccttgttgtcaaaagaagaaatggacatttgtcaaaaggcacacacatattaataaaaagtggtgatggtgatttttttcagaaagccaacatttaccaagcagctatgatgcttcctatattcaagtactctctaatcactttctcatttaatggccccactaggaataggatccaagactggctcctgtctcaacactctttctactcgacactatttctatttgttgtcagtagctcccacatctgctcttaaagcctgtcaaaaaactctcctttaactctgcccatctgcggtgacccaatagagaatatatatttcaggcatatcttcctgacaaagaactgttgtaactaatacaactaagttagaaacattttcctgaattcagttttagaacaaggctgatacaaaaacctcaggtcaaaactacaagattaaaaattaaagtgtggtccataaggtcatttagaatgctcaaaaatataagtcagatatgtggagaaagaatgaaactaataagtataatcttgaatatttcaatctaactttgataaaggaaacattctaaatatggcatatttgtagactaatggttgattttcccacaggaaaaaagtgttttgctttttagtttaattcaaatagcttgaaatgcctgctataaggtgtgactttaaagctaagactacaaactcaaatgtttaagcaggaagcgtgaatagggcagatgaaagtaaatagggagtggtgaggccttggcacactatactgtatctgccccgatttaaacacattcagatccaattgaccaaaccaaaagaatccctgaatctaatatactagcacagatgtttctgtgagccttattaattcagtcaccatgctgtgcattcatgcaatatatgtgcctgaccttggaagacctcggaaagataggaaatgcatgtctccgggcctgatgagcctacaataagccaaaaggactgaatgaggagcaactccaaggcaggaagtctgcctcattttaatggaaatagcataagctttgaggttagaatcccagtgcaaaaacactccaatagcaggagatttcaggcagaataattaacctcacttcagctacaaaatgtgaacaattcctaccttttagggtattaatgaagttaaatgatttaatgtcaaagacttttccagcattttcttatttgatgtctctccatgcaacaaactattagccatattccctctttacaatatttctcccctgttttcttagatgacagcaacctaaatttaaactgagaggtgtttacctctcctctaagttccagctgcatatctcaagttgagtctcaaacatgtccgaagttgagcccattgtgtttcctacactcccactccccatgtttctctccagcattccatctgcatggccctaatattcagctgatcaaaaagaaacgtgaggaatatccgtgacttttccaacccccccaacccccaccattaggtaaggtctattattacactcattaactatttctccaatatacacccttgctctgttcctcactagtagcactagtctagaggagaaataattagggataaaattaaggaagtgcacgtgaacacaagggagatgagagactacagaaatatttagtaagacagaactttttgaccaatcttttctctgtcataccatcagaggaaactctttaaaacttaaatctggtcatcactcctccaatgtaaaattttctaatgatggttaatccacaaataagaaaactcatattttttgttatagacaagcatgcttctctggcttctctctctagtcttacttcctactactcctgtcacggtcactcttttctccagatacatagaatccatgaggttccactggtgcctttgcatgagctatgttccagtctcccctgcacctcctaggaaatgactattcatcttttaagtcatcgtggattcttacattctatcacacacagacttcactcatgtgccccctttatatggcactagtctagcagatattttaaactattactctttgctgtaactatttgttgacacgtctgtgtctctcaccaaatcatgagttcctcctgaggccaaaatgatgtcttcattcctccatccactaggccttgcataggaactagctgagagtaaccaatgaattgataacacctctcaccactttaaagtaatgagaaaaccttgagggtcactgccataaaataatttacttttccatgaaataaaaattgcacttttgtaaaaggaaatcacaactgcaaaaaagctcagatatgctcagtctagaatggaaatgttttttaatcttccctgactaggctaagtagatttgtttatgaactagtcttcaaagttttctggtctaagcctcttttaaaaaaccagtgatgatggtttttaatcacttataagaaggtgtgtctttcagaacctattgctttgactctcaggatgttctaaaatatacctaatttctaacacattccccaacagaaacaagactgagaagaatgcagataaagatgtctcacacttgacatgcttttcagaaagttaaattagtgctccctatgttaaccaataactagattcatctgatcgaggaaaacagaggtaacttaggttgataatcttgctaaatttcaggtattctgaaaaactgatttcaacaagtatttatatagtggaattgtgcttagagctgtgagaaaatagaaataccaagtaaaatcaagtacccagctctgcagtcctctgttcttcagaaattgttagataatgatatgctaaaataataaatttggctaaaattagtgaaatagataataattaccataggaattataaggaaagcatgaaaagcttaagaaatgcttcagagagaggaagatgcacatttctaaatgtaccacgtaaaagctagtccagaaaaccggtatgaaagtcagttggcttgctagtaggcatctcagacattctgtatcaaaatttgagctcctgatagtgcccctcagcccactattcttacggtatttaacagttcagttaacagcaattcttctaattgccagtgccaaacactttgttgtcatctttaagcttctccccttctctcatatcccacatccagtctgtcagaaaatcccatcagttttaccttcatttatgaaaaatgtgacctcttattacctctacaacttaccatgtcactgcttggctcagaccatcctatgtatctctgtgaccccactcccagtactctccttgcttaccctgaccagctccatggacctccttgctgcttatccaagaagccaggcacatccctacattaggccttcccacggccggcatgctcttctagatccatgactccctaacttctttcaagtctttcctcaaaaataaacttttcagtgagacctcccctggtcaccctgtctaaaagttcaatcaacaattccaacctcaatatgccatatttcccttccttgctttattttctctgtactatttgtcactaatatatactacatttatttatcatgtttgttttctgtcttctccagtggaacgtaagctccatgaaggtacataagaggtgataaatatttacttcatgaatgaatgaacagcaacccaaatcaagaattttcaattaatttgacatattttactgatcacacatgcaaaaagttatcctatcatatggcaataaaataccagagaattggccaggtgctagtggctcacgcctgtaatcccagtgctttgggaggccgaggcgggcggatcacgaagtcaagagattgagaccatcctggccaacattgtgaaaccccgtctctactaaaaatacaaaaattagctgggcatggtggcatgtacctgtagtcccagctactcaagaggctgaggcagaatttcttgaacctgggaagtggaggttgcagtgagccgagattgcaccactgcactccagcctgggtgacagtgcgagactctgtctccaaaaaaaaaaaaaaaaaaaccagagaattatctagttacaacagggaagacagataaagggcatacaaatagcataaacttcctgctcccttttggctctcattctagaggcaaatattagaacattcacctgcatatcttaggatttggttttgtattctacttaggtcatctttcatgtttgcgagaattcatatagaaagcttctgaacccaaaacacaatggctgctgttgaaaggtcaactgcgtatgactgccaattagatggcaagttgtatttaaaatccagatccctaattaataacgattttgccttactcaagaactgtacgcagagcatgaatcatctatatgcagagtattcactgtttagttgttgccaatttaaatattcatgtctctaggaatggcttcaatccaccctggtgcataaaataaattagcattcttgcactctagagagaagtatgtgtttagcaccaaatggaatcagcagatgactaaatactctttttttcctctcttgtttctatcataaatacaacagatgcaagatgctggaatgtggacaaccccagaaggttggtgtttgcctctaatgcagaaataaaccattcaaaaattcattccatatagcataccagagttagcaagagcccttgggttcctttattgccatcaagttgactttatgactaaacatatcacagcgacccccatagtacaaatgaagcataaggctacctttgctactaaacatcacggaatatcttataaatttacagcaatgataactgattcagagttactacagttcaacagtaaattttgagcattacccaaattcatgggacacttaaaggtatgagacatggatctttaaatgataagttactggagtacaactgttcctatattaaatagggaaaaattcctttctaggaagactcagctctcttcaatcacacctcttttacaagcagaatgcgcaaggaaaatggcaggacctcaacagttgtctaattgtccggcttatgttcctcaaggttctctagcttttgctatctcaatgtgagtggtactttcattctcatttttattcactatttgatgtgtaaggaatgcatactcagagacagtcaatttcagtaaaaaatacataaataaatcttcaaccacagctaaaatcataattaatagtgaaaaactgaatgccttcctccttaaaataaaaaactaaacaaggatgtcccctttcactagttctatccaacattgcactagttctagtcaaataatttaagaaagccaaagaaataaaaggcatacagattagaaaaggagaaataaaactacctctctttgcagatgccataatcttatgtgttaaaaatcctaaggagtacactccccgctgaaaacagtagagctaataaataagattgatacagttcgcaaaaggcaagatcaataggcaaaaatcagttgtacttatagacacttgctgtgaaaaatctcaaactgaaattaagaaaacaattccacttaaaatagcatcaaaacataaaaaacttagtaaaaaaatttaacaagagaaatacaagatgagtatattgaaaactacaaaacatcattgaaatgaattaggcaagacataaataaatttaaagacgttccatgtcatggattagaaaacagtatttttatgatgacattattccccaatttgaactataaatttaatgtaatttctatcaaaattccaactgtgtttttgcagatcctaaatgcaaaaatgaattttgtaatcctaaaattcatatgaaaatgtaagggactcagaatagccaaaattatcttgaaacaaagagcaatgttggaagaattcccctcatttgatcattacacattatatgcttgtatcaaaataccacctgaaccccaaaaatatgtacaactattatacaaacatatcaattaaacattaataattcttttaaaaagaattcccagtttcaaaacctactacaaaactataagacagtgtgttacaatcataaagacagacatatagatcaatgtaatagacatcagagtccaaaattaaatatttctatttattgtcaattgattttcaacaagggtatcatgacaattcaatacagaaaggatactcttttcaggcctcgtgcagtggctcacgcctgtaatcccaacactttgggaagctcacggcaggtggatcacttgagtccaggagttcaaaaccagcctgggcaacatggcaaaaccgtatcttaattaaaaatacaaagattagctgggtgtggtggcacgtgcctgtagtcctaactacttggggatgaaggtgggtgtggtatgcggcaggaggaccacctaagcttctgggtgttgaaactgcagtgagccctgattgtgtcactgcactccagcataggcaagagtgagaccctgtgtcaaagaaaaaaagaacaatcttttcaacaaatggtgctagggcaactggattcttttttcgtgttttttgtttttgtttttgttttgtttgtttgttttgagacaggatctcgcttagtcactaggctggagtgcaggtggcacaattttggctcactgtagcctggacctcctgggctcaggtgattctcccacctcagccccccaaagagctgggactacaggcatacaccaccacacttggctggtttttgcttttgtttttattttggtagagagacggggtttcaccatgcttcctaggctggtcgcaaactcctgggctcaagcgatctgccagcctcagcctcctgaaagtgctggaattacaggcatgagccaccacacctgagcaacaattggatatatacatgcaaaagaaaaaagctggactcctacctcacaccatacagaaaattaacaaaatggatcacagaccatttatgcctgtctcaacctatttatgcctagtgttccattattggaatgctaaggatgtgggagttatttatatcctactgctcaaggtcattgccaaggtctgattgcaaaaattcaaaaaattgcaacctcaggcataaatgggttttaatataagagctaaaactataaaacacttagaagaaaacataggagtaaatctttgtgattttggtttagatggcaatttattagatatgacaacaaaagcacaaacagcaaaagaaaagatagataaatcacatttcatgaaaactaaaaaattttgcttatcaaagagtactataaagtaaaaagacaatatacagaataatagaaaatttttgcaaattatatatatgatgtgtcatatatctggaatatataaagagctataaaaactcaataataaaacaattactcattaaaaaatgggcaaagagtctgcatagacattactccaaagacaatacagtcatcccacagtaccacagggtgttggttccaggaccctcatggaaaccaaaatctatgatcttcaagttcttaacataaaatggcataatatttacatacatcacatcctatcatacgctttaaatcatctctagattatagtaaatcctcatttaacatttttgattggttcttgggaactgtgactttaagcaaaacaatgtaacaaaatcaatttactataggctaattgatataaacaagggttaactttctaccgtatgtattaccgagcttgtaaataaagaccaaaacatttctaatattaaacattgaaataaatgtgagccacacatacatttaagaaagactaaggtaagtatttacccaattattatcattaaaggtggcaggtgacagagcctatcatggcagctccaggtgcaaggcaggaaccaaccctggacaggataccattccattgtacacagggctcagtcacacacatacccacactcattcatactgtgacaatttagattcaccagtttacctaacatgcacatctttaggatgtgggagaaaactggagacccagaaaaaacccacacagacatgggtagaacacgcatacttcacacagttagtggtcccagctaggtaccaacattggatgaaacaacattattggaggacctgctgtacttacaatacttaatacagtgtaaatgccatgtaaatagttgttatactgtatttttaatttgtattatctctattgttgcatttttattttttattcagattcagttgacccttgaacagcatgggtttgagctgcacaggtccacttacacagatttttttcaaccaaacatggatccaaaagacaggatttgtgggatatgaaatctaagtatacagagggccaacttttttttttttgagatggagtctcactctgtcacccaggctggagggcagtggcacggtctcagctcactgccacctccacctcccaggttcacgtcattctcctgcctcagcctcctgagtagctgggactacaggtgcctgccaccacgtctggctaattttttgtatttttagtagaaatggggtttcactgtgttagccaggatggtctcaatctcttgacctcatgatctgctcacctcggcctcccaaagtgctgggattacaggcatgagccaccgcgcccggccacagagggccaactttttatacacatgggttccgcagggcagatttcaagactcgagtacctgggtatacctgagggtcctggaactcatccctcatgtatacagagggatgcctgtatatttcagccactgttggttgaatctgtgaatgtggaaccagcgcatatggagggccatctctatacaaatagatcacatatgcatgaaagatattcaacatagtagccatcagagaaatgcaaataaaaccacagtgagttatcacttcacgcccactaagatggctatgataaaaatgcccataatcaataacacttgttggcaaggatgtggaggaaataaaactttcactcatttctaggctgactgtaaaatggtacagccactttggaaaatagcctggcagttcctcaaaatgttagtcatacatagaattatcataccacccagtaattcctctcttcagtatgaaatcaagagaaatgaaaacatatgtccacataaaaacttgtacatgaatgtttatggcagcattcttcataataaccaaaaagtagaaacaacctcaatgtccatcaactgatgaacaggtaagcaaaatagagtatatccacaaaacaaaatattatttgtcaatgaaaggggatatagtactgatacatgcaacaacgtggatgaatcttgaaaacattatgctaagtaaaagaagccaatcacaaaaggccacatggtatgagttagtttctatgaaatgtctctagaataggcaaatctatagagacaaaaagcagattagtggttatctgggggttgggggcaggagtgactgctaatgggtacagggttgcttttggaggtaaggaaaatgctctaaaattaggttatatattgattgtcatacatctctgtaactatactaaaaactattgaattgtataatttaaatagggaatgttatgatatgtgaattatgccttaatagagtggttagaaataaagacaaagacatacccatacatatgtcatcagaaagaggagtgaagaggcagcctgtcctaatagtaaaactcagacttgaaggatgctaatactttggcagctcagaaccaatgaggaagaagaggaagtcaagatcaagggacgggggttggaaaactgctggtttaaagcacttaaagaggccaggtcacgtttgtcaacagaaaataatctcaatataaattacagatagagccccttctagaatttgccatcgtatggtcaggtcacaacagtaaggaattcaagatttgaggaagagagggaggggcagtattaacgtaaacacagagagacatggtatccagcatcaggaaactattttccacaagatcatcactagtggcctcagatgtttagaaagagaatcaagacctgaggaggtggtggctcacacctgtaatcccagcactttgggaggccaaggcaggtgaatcacttgaggtcaggtgtttgagaccagcctggccaacacggtgaaactctgtctctaccaagaaacacaaaaattaaccgggcatggtggtgtgtgcccgaagtcccagctacttgggaggctgaggtgggagaatcgtttgaacccaggaggtggaggttgcagtgagcagagattgtgccactgccctctaacttgggcaacagagcaacagagtgaaacactgtctcaaaaaaaaaaaaaaaaaagacctaaggactaaggagtaaggtagctattacgtggagaattagaagctcatctactgtctgaggttgaaggaggcagtacagtcatcccccttatctgcaaaagatatgctccaagaccctcagtggatgcctaaaaccctggataataacaaaccctatatgtactgttttttcctatacatacatacctatgataaattttaatttataaattaggcacagtagaaatcagcaacaataactaataacaaaatagaacaagtataacaatgcactgtaataaaacttatgtgaatgtgttctctaactctttctgtctcaaaataccttatcatactgtactcacccttcttcttgtaatgatttgagtttatacgatgcccacaggatgacatgaagtgaggtgaattacataggcattgtgacataccgttaggctactattgccgtgtattcctgaatcatgtgtaaccatcccttacttgaaataaatggcttggtgtcacttgtttcaggagactccttgctgaaattctcaaataaactcaatgttttctggtgcaacatgctgtcaatcagaacacattttctgtttatgtctttcaccaacaaatttaatgcattttccatctaattaatcacttattatgcactgtatctgtaaagtttgcagtttgaggtatgacaaccaaactagaatttctttctccttcttcacaatttaatggatagaagattcattcttaccatagagcaacctcagcatacaattatttttttccttactaattcaagaaatttcaattttgcacttaaaggaataactttatgggttctctttggcatatcccaaccaccagcatcactactcttgtgctttggggccatgttaagcaaaataaggattacttacacacaaatgctgcaatactgtgatagtcaacctgataaccgagagggctactaagtgactaacgggcaagtagtatacagcatagatgtgctagaggaaaagatcattcacatctcagcaggactgagcaagagagcacaagatttcaaaatgttatgcagaacaatgtttaattcaaaactcacaaattatttatttctagatttttcatttaatattttcagatcacagttgactgtgggtaactgaaacctcagataaagggaaattactatatttttagaccatgcaagtagaaagatacaaggaaaatgtggagagttaaatagggctacaaggggttaatctatagttcaaagactaggatgtgggagatgagcgagatgatttaaatgttctctctctctctttccctctcctacacttaagtcaagtcctgggaatggcataagtatataatggaggccatcaggggattcaactgttgggagtagagaatgcagagtcaggaggtaaccggcaatgccaataccatgggagattgtagctgttccctgcagtttcctccaatgcagcaacaccaaaggaaatcataaatgaaaaacgatggtgatgatgaaccatgactggcagaacaaagcacaataccaaggccaaattctgggttttatgggcccaggaggcccagaaggtaatgcaatatgagggccactcaaatacccatagttccttcctgactggctattcagactcaggatccagtataccaggaatgaactacgaaaaatatgtactgtgtgtccactatataaacggcagtattctaggtgctttcccttccttctatgattcatgcatagagagagagattatttaaactgcaatacagttttcctttcttaccaatttattttcaactatatgctctaaatatttacaagttcctctgttgtccttttcaggatttaccatcttgctacctttcatatggaaaatactggcagaaaaaagaagacattcaaagttgggctcataaaagaaatgccccaaagtggcccccgagactcactttagttcaaactatgcagtgacttataaattaattagaaacatgaacaaattgcagctaagaaaagccccctaaaaaaagaaaagaggaagaagtaagagagagggataaataaaaactaacatgtatcaagtgtctgctatatagatggtaaggttcaaggtattttcccttccctgtgaagtgggaatcattatcaccattcttattgacaataacagaaacacagaaggatcataactcatccaaggtaataggattgctactacagatggcactggaacctaggtctttctgatctaaatctatactctgagcccaatgtaatgctacttctattaacaggtctctcaagctcactattctaatatcatcatgtacaacaaaataacattttagtcaacgacaaaccacatatacaatggtggtcctgtaagatcgtaatgtcgtatatttttaccttttctatgtttagatatgcttaagtaaataaacaccattgtgttacaatcccctgtagtatttagtaagtaacatgctgtacaggtttgtagcctagtagcaacaggctgtatcatgtaacgtaggtgggtagtaggctataccttctaggtttgtataagtacactctatgctgttttacaatgaaatcgcctaatgatgcatttctcacaagtatctacattggtaaatgatgcatgactgtttatcaaatgaaaggcctaaattttgaagtgtcactctaaaatttttgtgtgattgtttctatgctataaaaccacaataatttctggccgggcatggtggctcacgactgtaatcccagcactttgggaggctgaggcaggtggatcacctgagatcaggagttcaagaccagcctgaccaacagggagaaaccatgtctctactaaaaatacaaaattagccaggcatggcggtgtgcacctgtaatcccagctactcagggggctgaggcaggagaatcacttgaaccagggaggcagaggttgcagtgagctgagataatgccattgcactccagcctgggcaacaagagcaaaactccatctcaaaaataaataaataaataaataaattaattaattaatttaaaaaactacaataatttctaaaatctattacaactccaaaattctctaattgtatcttagtcaaataatatgcagaaggaaaattacacaacttaagattccaacaatcctgagacctatgtttcttctatgtattacataagcacagacgctaattggctctgtgtatagtgcttattactggtgcttactgctatacccgctttatagctattaaatactttaatccttctaataaccctatgaagcaaattattgtcttcattttataaagaaactgacatgcaaacatattaactgttcaagttaaaacactgataagcagtgaaggtgagatttaatccaaagtattttagctccagagcccatgtgtgtaactgctaggctgtcggactttccagtaagaactgaaaaccttctcctagaggttcacagtgttttagttttgtatacattttctcatttgatcccattatattgtgctcattacataaattaataatctaagaaaacaatggcttatttaatgtcattcagctatcaaccagcagaaaacactcttctaattcttgcaatacaccatgagatttttttcttagtgaattcttaccactgaaaaccagcaccaccagagaaataatcacttaaatataatagatatagagtatatataacagataaaagagacaataagaacagcagcaaaaaaaaaaggatttctctcctttaaaattcttagacccttaaattatattattttctctatcaccaaactggactagattacactaagacctttgaagcttagagatttaagacaattagctaaaccattaggaaaatattatttgccacacctttctcttgccttgctctttctttaatttggcataaatgcattttttctaactgcattgattgttcaccaaactaggaagcttgctcttgatgctagtgaagcaatgtcttattatcttgattgtataccaagattatgcttcagtctgaattgtttacttaataatttcactgccttaccgaatgccttcttttgatctgtcttgatgtccaaaaatattagggcattaaatttattttcattattaaaagaacaatatagactataaaaaccacatcgcttcagctcctttttgcataatatgatgggacacatgaatttgatcattaccagatggtttatctgaaagattacccaataaaaatgactgctttttccctaaagtctctttatccttacattcgattaaatgacataagatgggatgatctagattttcttagagtgaattatctgggaatttaacattgctttgaaaagtctctgagtgatgttagacatttatttcccaccaggaaggataaacagaacacaacataaaatattcaccctaagctttaattaaaatcatttaagatcaaaaagggaggtagcacagcaatacagggaggaaaactgcaaaaacttcagtatcatggacattaaaaatacccagtggtactttttttagtgaaatttttagaacaaaatcaatttaaatagttaagaaaaagtttagttaaataaaaaaaattaaaattgcaaaatgcaaactctgtttatgaatgtcttcctttaaataaaaaaatgcatctttgctaagattttatgcttatagaaacacttgcttactcataattcaaacatttcacgagtttccagctataaacatgtttataattttagaattctgatagcagataatcattttataactataaaacaatatcaaacaatagttatctaaatagtttcttgaatcatcatgtgatgtttacacagctgggcatttaagaccaatgtgtgagagataattgcatagctataattccgagcctgttgttttaagaacaagcaggctcttggggagataaagacagggtttgtgattttctaactcaaaaagtaatctggagaataaagtatgtaaagactcctagagtgcaatgctgaaagcacaaatttcagtttaaactaggaaaggcaaaagctaatgttttcattgccacattaattttctcacattatacctgagcagtgttcttgtttctaattatattcctacatgaatgccttattacatataatgtgggaaatattacagtgtgatatcttgtgtttcttggcttgtgcttcttttatatttataactttaatgttctacttagtgagattttgtatataataattatgctccagtacactgactctgctccacaaaacgcaagtacaaagttctcttaaacagcgggtggactagtgtttcgtgcatgtttttttggtcttgttttgtcttgcgtcatttttgttttggtttttttgacaagttggataagaaaaaccaaattttttctttaattaaaaacaataatggaaaataatattacagataatataaaatagaataaagaattgaggttttgtgtaaatttttgtgaatatatctgaaaggttttctgaaaaacatgaagtgttcaggtgtgacttccagaagctgaaaagcaatagctgtttagactctccttacatcatcacaaagtttaacaaaactgacttcttgcccaagagttcatgaaatcatttatactcccaacatttattaagggcctaatgtgtgtgtcagacaatctgccagtcacctgggtttcagattaacaaggataagtcctttccttgttccttctacatatgcaatccctcttcaaaaatctgcatttccttgctcatttcaacaatggttatcctttgtttgtttgtttgtttgtttgagatggagtctcactctgttgcccaggctggagagcagtggcttgattttggttcattgcaacctccgcctcccaggttccagcaattctcctgcctcagcctcccgagtagctgggactacaggtgcacaccaccacacctggctaatttttgtaattttagtagagatggagtttcaccatattggtcaggctggtcttgaattcctgacctcaggtaatccactcgccatgacctcccaaagtgctgcgattacaggtgtgagccacagtgcccggccacaatgatttttcttaaaagtacttgtcataatacccaaattttcttaaagtaacaatttatagttttccaaaagcgaacacctagagaactttcatggcactttgtttagccgacaactttgaaaattttattttattgtagtaagaacacaaaataagatctatctttcaactgtgattttttttacccttaagtgatgtctgctttattctatccctttccatgaaaactgaagccccaaaggttgaatgaatcttaaaaattagtcactttctcagtgtaaaaacattcattgtatcaatatgtaatttaaatatgctatttttcaagccaagtattgtttcagaattaaaggtgttcaaatattccctcaagaatatgtttgtccttcgtaccagagggcattggttctaggatccccactgataccagaattctcagatgctcaagtctcttatataaaatagcatagtatttgtagcaaacctacacacctcctctcatatcctttaaatcatctctagattacacataatacctaatataatgtaactactatgtaaataattgttgtactatattttttctttttattatttttattgttgcgttgtgctctttttccccacatattttcaacccacagttgattgaatctgcagataggaaaccagtggattcagagggacaactatattctccaaaacataatcttaaatgctcacattttagcttttaactacttactactacaacacaagttcccagtctgcagaacctaaacccattctgcggagtgaaacccaagataatcactctttaagtgtatctcttagttgtctctccatatttttatagattggagacatatctttacaacatcttttttatcagccttaaagctctgaacataaatctaaaacatcaaatctcaacactgaccctgaagttatataatgcaaaaacaaacaataaaaaaaaaagcatttagcattaaaagagctgaatacaatcttggctcacctactccccagtaagttaacaagacctgagctaatcatttacgcagaagcttggatcactttacagagtgaataatacttatcacaaggagagtttggaaagatgataataagataatatgcatgtgagagcacttacactgtaaaatatacgtccctgaggttgctgcctgctgcctacttcatgactatttttgcgccactttatgttcccgcttccttgcttctaactcccatgaccctctatgtttttgcctaattggcaaacatattctcagtttctcagctgcaggataccaggtgaccttgctctctgattctgcctcttttctactattagtcaaatgaagtagcttcataagtagcacaggcagtttcctgtaaagtgtaattgggatagtgttggaagggcccctttcccaaacacacctcctctactgttctgcctagggcatgtagtttcatcatcaaaatataattatcataccatatatactatatgttagtataatccattaccttggattaaagcacaatttcttcagcagtcctttactagatgccagtaccctaaagaataaactaatcaagtaacatgtatttgctcagcttattttatatacattagcgctgcgctaaataacaaatgaacccaataacggcatcgtttcctaaataagagccatcatctggagggagtgggaccacagaggttaggtgtttctcattcagcatgataatggagaaggaaagagtgggcaagaacctagcttctgaggaacagaaactcagaagatgctacactcggaagaggacccaaagtagccacagtgcagaatggaagtcttatgtatgaaaaggattcaaaacactatgacatttgctgttcctttataattagccttctctttgtaagtagtcctaatgaagaaatttggcaacaaatataaaatagtttctccacaaaataattttagggactcccttaaacacagaaaaaaatgtagtagctgttatttaagtgcccaggaagtctcctcactccaaaatatctctcacattcaacacctagaaattcattcttctatagatccaaaccattaggcaagaagtgtcctaccaataatgccgtccttgaaatgcaagcattgcaggtataaataacattgaatcataacatgctacgtgactttcactgttttgttttgtttttttgttttttttttgtttttttgaggtggagtttcactcttgttgcccagcctggagtgcagtggctcaatctcggctcactgcaacctctgcctcctgggttcaagcgattctctcgcctcagcctcctgagtagctgggattacaggcatgtgccaccacacccggctaatttttttatttttagtagagatggggtttctccatgttggtcaggctggcctcgaactcctgacctcaggtgatccacccaccttggcctcccaaagtgctaggattacaggcgtgagccaccacgcccagcgactttcactgctaaatccatttctttgacaaaagaaagtgaagttatcaagtgctctgatagaaagcctcagtggtcattcatgtggtcagcctgtctataagtcatcttggggactggtttttaataagcagagggtttcctgtgctccaaaatttgcttagggctgaccctgacaactctatttatttatttatgcatacaaacacagtttaaattagcaaacagatgagttaaaataatgagattaccaaatgaacacaaaaggtatcctgaatcttcccaaacccaattcaaagccaagccttaaaatcaagagggacagaagtgctcagcaaaccacctgcaatttaactgagttcaaggagttaaaaggtcttaaaattaaccatgaaatgtgaaaaatatatgaatggtcttcaaaaacaacatttgggaaactttatgtcagaaataccaacactgtggttgccaagagtgaggcattttgcgatgactaacaaattaaggcatcttaatgtgaaaactgattatataatgcataatcaagcagagtaaggaggaaacagaggtatgctttctcattaattctggcttagaactacattgcgtaacatcaccagatttatgaatatagagcaactttaaaaatccacggatgttccctgaatcaaatcatttttatagctcaaagaggctgtcatttcaaatacacacatttattcaaaatatttttattgtctctatttactataaaatctcaaaactatagtagtcaggatggtcagcaaggggtaattggtccagaaaaacaattcagaaaagagaaatcagagaaaaatggctcattttcagtgatgctgcctctagttcatgttggggatttttttctttatgtatgtagctacacagggttctgctatacaaataagttggatatgttttttaaaatcaactaatactaacacaaatgtagcactgactatgtgttgagaactgttctatgtatactatctcatttaaatataatactcaatacactttaatgatgcatggtataatattgtacaataatattaaatataaattgctcaatctcattcaatatttcaatgatctgatactttttagactaaaaataaatgggaaaagagaaagagagaagagaaaaggcataattattattataagccacaagttttcacgtataataggatgaatactatattggcattcaagtaatttagttcccacaataaataataagatacatcatccaacctattatctgctatatcataaaaataattttatatgcaggatcaaaaggggtgattttcttgacttttctgtgactattttcaaaagtcatgaagcagaacatccacgcaagaggataaactggctctgcagctgacccctggaggtactaatgcagagtttgaaaggggaggaaagcttattactagtgaccatgagattccccaacttatattagtcagaaatagcaccccaggatggaatactaaatcataagggtatcctacaaaggcagtctagaatgtgagaggtctaggatctgtggatgtcagagaagtctgtattttcacaaatcataaaaaccgaaaccgctttaaacagtttttttaaaaaacagctcatactccctctgtgatttcacaaaaggctgtccgtggatctttggcggggaaaaatccctgctagagacaaaaaggggaacaaattaaacaacaatataaaacccaaattgatttaaaacttgtcaggaaaaaaattatttcacaaaagcaaagaaataatgttaaaaatgagaatgcaaaataacacaaaggggaagtgaaaaatagcaccgctaatcagcaaaggcaagagttccaataaattacggctcattctgaaatgacagactccagggtgttttcaatcagtcttcagtgagaaaatatttaaaaaggaagaactgtataagttcaagtaattaacatcttacttgtataggaactagttagtagggagaaggggataaaacttgatgccataacacagcacttggagaaaactaagtctctacaggttagcaggtccagatggcaagaaacccaaggtaatataacaagcagtggtggagtatttattcaaactagtcaatcatcactgcaaggccctggtacctttcttttacaaatgagttcttgtttcagccatcaacttcatcatccccagaagcccaaaacaacactccagtttataacctgattgaattgcagtgatttcagacctagtactattgtgatctgggatctttttattacggcatcataaacatcactttcaacaactttcctgtatgtctttgccccgttctgagagatataagtcagaggtggagaaaaggctacaaatgcgttgatttgtggcatgaagaattgtgcagaatcttttcctttgatatgacagtccaaggggtatattaacaagggcagatggttgccatcatttgttacaagcacctattcattataaaaaaggaaaaacaactcatccctcaagaaaggatttaaagtgataccagaagacctcgatcttccactctccagcctccctgcttcatcttggtaaggatgttgttcctaacccttccttctatgccagggaaaggatatgcaaactaaaaaagaagaagtaccagatgtgaaattctataaaatgccaactgattcacaccctacactctgaggatttacacacacttccacttctggcaggaccaagggtaatgagaattctgctgtcgctggtgaagaagtagcaaatcacagccaaaaaggacacctacccctgggaacgagaacttcaattccaataaatgaggcaatgctgatgagataaaatttacatttaagtcacaaagctactggaactgaattgtaataaaaaaaagtgtcagacaataaagcagtttgataacgtcagcttttttactgttgtgtgtgtatctgaaagaaagtttctttaaaaaaaaaagggtaacatttgaactagcattgaagttatattattttacaatattttatattaaggaaatatcaaaaatgaataatatactatagtttattaaggacacatgatgggttagggacttgacatgttttatctcatttagtatacttgatccagatagacccatttttaagcagcagcagctcagaaagggtgagtaactagtccaaagccctggcggtaggaaggaccagaagtgggattcaaactaaagcctgccagactcctaagtcattgttgtttgtgcctcagattccctttgcaaaattcactattaaattttttcaaagttataataataactattaagggcttactatgttccaggtatactgtctcactatatctccaaacagctatatgaggtactatttcacctatttacagttaggaaactaagactcaaaggaggtaagtaacatgcccagttagaaagtaggataaacatgattcacattcaaatcactgcctccaaagcctcagcacatttccaaaattcataagagctacaaaattggaacagacattaaatgcctggtctttggggaattcctctattctgcaaattttagatttagattcccacctgtctagcttcatcttttatgtgtttgttttctcctctcttcttctcattatagataccataacttcctagattcatgaaatgttagagatagaggttcaccctccgaaaaattgacctactgaggactaaaagtaacttaataacaaagtacaatatacatcccaaattgctcaacagttggataaactttccactgcatgatgccgtaattcaccatttccaaaataagtaaatatgaaggcatcgagaaaagactatgaaaaatccaattctagtgttttgaaggtaacaattagatataatgacttcgtatcaagggtaaatttttgaaatcagtcactactttaataggattttcttatgctataaaaacatcaaaatatgcaacctagctttgaaagctctctaagttgtgttcccaacctggcaaaccctgtacaccagctcatctgttctacttgccatacctagtataagtccttgtctgtcctatttctggaactgtgacaactttctccacatttccatcttttaaaataatcaaactcaaccattcatccttatagcttctatcacaaagtcccagccatgatcagttgaaggctcatattccgttactttgaaattctatcaacagatttatgatgacttgattatactttttttatatcttctctttccccaagacttccctaaaatggtgaaagagcaatagacacatacaaaacaaataaaaggcctaactgaatgagattttcagcatatttgcaaggagggtgctaacaaaagatggataacttacttagcagggaggggaagctataactttaaaaggggaataaagataagagagttgattcacttcacagaacccttaaggaggtttggggtttaaagtctgtttctatggggtacaaaatgcccacacacacctccctcctactccctgcactagatacaagcaccaagagaataccgcattttccatgggataaatttaactggagtagctcaacactcagagacatcaggtactgtgaagagcaaggaaaaaaagtggattaattaaacatccatgtgttgagttaagagatgcctcctcctcagcctctatctcttcatgtgcaaaaacctggaaaccaggcatcttccacacacataaggaatcaaagattacttccttggaaaaactgacctgccgcagagaaaaatatctttattctcagcttgaggttctccagcaaagtgctaggtcctaacaccccggagattccaaaatgaaacagatcaatcgacaaggcctagaaacagatctgcaaatcagccttttaatgcttcattcaaacctagactgacacccaagaaacaccaaacatttcatgaaagatttcaataaaaagagagaccaaaataaacagagaaaaaaattaaaactggaagaagctgatatacgctagaaagagaaaaaagtcatcaaaaaattttatcagtatcctcagaaaggtaaatgattaagattacaatcttaaaataaggacaggatactacagaaaatgaaaaagcaaaagacaagaaagaacactaaacaattcaacttacacttcatcttatgcatgcagtgaactgtatttttgttcaaaaaaaatatatatgttctacccctctcagaggggaggctatcctcccctgtcccctccatggctggctatttgctattgatttcctttgggcaatgaaatgtgtttgaatgtgatgtttcaccgaaaccttagagcgagcatgcggttggcatttttccccctctggcacaagactggcaatattctagatagcagttagaatattgatataatctagaatatgatataatctagactattgatatcatctaatattgaatattagattccagcattttgaatcctcaaaggaagatgatgtggacacatctgtagctgacccacagtgagtaactatcatgataaggaattaactttgtggagatgagtaactcagaaatgaggagttgcttttcaaagggtacaaagtttcagctagataggaagaatacactttaagatctatgtcacagcagggtgactacagtcaaaaacaacatattgcatagttcaaaataactaagagagtaaacttcaaatgtatcaccacaagaaaaaagttaaatagtgaggtaatggatatgttaattaatttgatttaatcattccacactgtatacatacatccaaaacatcaaattctatgctataaatgtaatacaattatgatttatcaattaaaaataatattaactttaatagaattaaacttttgttgttgaaagcttttgaaattctgggcatgcttttttacttcagataatctggtctatcctgacaattacaataggtttgatcacattgacagggctttggattttattttaaaagactgacccaaattagtaggcacatagaaaacgaagaaattaaaacacaaacaattcttaactctggataaaacgaaaagaaatataagaacaaactgtagccattttacactatgtgattcagagtaaaaaatatttacatagtaataatagcataatcacttcatactggctgaaataaaaacacgaaattactgaaaggataggaagaagttctgtgtgtgtgtgtgcatgtaaaagcgatatgaaaattaaattataatcttctttttttgtttttgagatggagtctcgctctgttgcccaggctggagtgcagtggcacgatcttggctcactgcaagctctgcctcccaggttcatgccatcctcctgcctcagcctcccaagtagctgagactacaggtgcctgccaccatgcctggctaatttttttgtattttttagtagagatggggtttcaccgtgttagccaggattgtctcgatcttctgacctcgtgatccacccacctcggcctcccaaaaattataatcttcttcaaaaggaaatctataaagatctaaccttgaaacatcaagaaaaacagtatactgtgtgatatttagaaatatgaatataaatactagaagaaacaattaaaagatttaaaatagttgcctctgaggcatgagaactgggagacaggctggaacatgggacagctattttttattatagcattatttgatttattatatgtactattttggtaaaagtgaaaattaaatgaaaacagtagtttactcttatcttttacaaatactgagttaaatatcagaagaaagagccaagaatttaaaaatagttgtctctggaaaataattgggaagtgaagaggggttaagcacataataatttgataaaatttaaaaaattaaaattttctaagagaaaatgagtaatctgaaataactgaaatttgtgaataagtggaatttggttttggcatagtgggtcaaatcatcagaaaacaaactcatatgagaaataaactactcaatactggtttatctcctggtagaatcaatcatttaacagtggccaagcatggtggctcatgcttgtaaagtcagtattttgggaggcgaaggcaggaggattgattgacgccaggagtttgataccagactaggtaacatagaaagactcccatctctacaaaaataaattaaattaaattaaattaaattaaattaaattaaattaaattaaataaataaataaaaaatcagccgttagcggcggctcatgcctgtagtgccagctacttggccactaaggcaggaggattgcatgagcccaggagttcaaggctgcagggagctatgatcacaccacttcactgggcaacaaagggagacccagcctctgaacaaacaaacaaaaaagctttgggtccctctacggccttttttgtttttcaaaatgagactttttaataaggtcacattgggtgctttaagaacttcaattattataaagcgtaaattacttttaatatgcagttccatacttagactgcacaatgcacatctcagaggcattctcaacaaccattaaacattttgaattcaattttcagttaaaccagtattttattaacaacagattccagttaaatacaacaaatattaaacagctattgtatatgcaaatgacattgccctaggctttgttggggataaaagttaaaatatctcaatctttaattgagtttataatcttccaaggaatataagccatgcaataataactactaaaaataaaaaaaatgtccaaaagagatggttaaaggaaaatccttatcattcagagaaccgtggtcattggaaataggatttgaacatctgaatccagacagagaattatctaagagtaaaatagtatcataaagcatgagagaaggacagtatggcacatgtgagtgcagaaaatcattcattttggctggaacataaggtggattcaggggagtagtaaaaaataaataaagtaaatagtctgggagaagatcatggggctccttgagagtcaagttaacctttttataattcatataacagaaaggttggagtcattaaagattttttatgaacaagtggcttatctagatttattgtttaaaaaattagtccagaaatgtatatgagaaggattaaaagggaaaggatgaaagctatgttttattttatattaatagataataatgagaaaatcttattctctgaataaatagctagacatacattttgaggattattattctcaagcactgtgtacatttcaaatgtgcttcaatattttgtgaacattcaatattttgtgaaggtgttttagagaagtcataagcaagcaacacatgcattgagctctgtaaactctgtttatgttattaatcagaatagctcctgtccatctaaaggaggaatagatgtctttaagaagaaatgaaaaaataaagtaaatgtgaaaatttcccttacttatttccaaacaagtgctcctccaaaaaaatgcaaataattaagtttctgaaatggtgaacatatcagattagtagacatatggcaggagcagcaaatgagcagatcaagttgaagtcctagtattaccaatctgttaatgttgacaggaagactcattttgactgttccttttatatcaataaatgagtggatttcaactactctaaataggaatgctaaaagcagcactgctaaaagtgcatatcaaaccaataattttctgatgctgttttggtatatcctacaaacatttgtaggacaacaactcagaagggaaaaaaatatcttatgcctttgaggtctgtactgaatgctaatgcatttgtatatgatgggtttaatacagaactgagaataaattactttcagcagctgcactctagacctataaatcgctctgagtactacaaaatccatacaaaggaagaacagctggataatttacaccaccagtatttgtcaaaaaaaaaaaaaaaagctgaaaatacagaacctgatttgtccctttttcgagtatacacgtctacaaaaattaaacattatctttctagagaatctattaggataggcacatctattcgcatcttgacatgttgctcttttaaaataaacataattcctcttattttaaaagcactttttaaaaggataaaagcagcaaagaaaaaaacttttccttataaccaaacgcaagcacaaagaaaagtctgttaatgtttattttgtgttccaattgctatgctctggtaaaattctacaaaaggaaacacgttaaccagatgacttgcagagcacagtgataccaaaaatagtacttaagttaatacactaattgcaaagttgcagagattaagttcaccattctagttcttggataaacttttggagagggagtatttaaagtttaatataagggctgtcttaagcttcctaaagaataatacaagcagtaaaaatgtgctccgtataagtgaactccagaaatagaaagctgcagtcactaaaggaatattagcttttgtgtaagcaacaaaattacccttttgcaacttctattaaagtcaatacaagagagtggctaatggctaattttgctcacaaatctaccattgttttgagtttttatatgtgacgctaattcgtaaagaagccatactaccttgataataacaacaaagaaaaattcttaagtccccacatggtaattactgtgatctatatgtagaaatttgacaatatgtcaaaatttgaacctattttcaaatgaacctatatcagtttcagaaatctaagcgttcctaaaacaatgattaacaaaaaccaattggtgttactctccaaatcatgcaatctagtggactgtaattccaatattataaaaatgctgtgataggaatatgcatgagtgaacaaacaggcggctttatctgcctgccaatttcacatccactggaaacaaaaggaataggtgaggttattcttaattgatgcctgtcaatctttcttttcctacactactaatatggttaggctttgcgttcccacccaaatctcattttgaattgtaatcccaataatcctcatgtgtcaagggagagaccaggtggagtaatcgaatcatgggggtggttcccccatgctgttcttgtgatagtgagttcgttctcaggagatctaatggttttataaggggctcttccccactttcgcagcactcaactctgtcctgccgccctgtgaagaagttgcctgcctcccctttgtgttctgccatgattgtaagtttcctgaggcctctccagcaatgtggaactgtgagtcaattaaacctctttcctttacaaattacccagtcccaggtatttcttcatagcaatgtgagaacggactaatacaactacactcttctaatcactttattttaaaatcagatagcttggagcccaaacaaggcctcctctctgtcaattgtccttaatctgaactcagttttagaacactcacaaccacataggatataaactcatttagcaaaatgccagggaaaaaaataataggcatccagtagtagaagtaagcaaagattgacaaagaatccaagccctaaagtgtccataaggttgaagagtttaaaaatgacacactagtttatgtgaagtaagagtcatgcagataactggaggacttatctacttatctgtatttctctcaagttatgctgcttactagttcacagcataaaccaccaaccagatggcttaattgcacagcagacattcttacattgccttaaactaggaatagagggctactagtaaatatacaaaaataaaacaagtaacattgtttatggcccactaaactgtatacatttatgtgattctcttccctatacctctgtcacaactttgtatcttttctggattctctcttaggagttcatggactgaactgagctaactttaaatgcactactatacttaactattctataattctgaagttgccgtaatttctcaagttaaaataccctgtggttccaaactcaacccaacttatttcaagactggtagcacccaatttttttaaatgtccattaaggctgggcacggttgttcatgcttgtaatcctagcactttgggaggctgaggcagatggatcacttgagcctaggagttcaagaccagcctgggcaatatcgagaaaccttgtctctacaaaaaaatacaaaaattagctgggagtggtggtgcatgcctgtagtcccggttacttgggaggctgagatgggaggatcgcttgaacccaatagttggaggctgtagtcagctatcattgtaccactgcactccagcctgagcgatagggtaagaccctgtctcaaaaaataataataaataaataaaatgcccattaaataaaaatcttaagcaaagttaatactttattaattcattgttgtggaaaccaaaccattttagcagaagagaatacaaaataatgttcaaagaatagggaagaaagttttagttctcataatttgcaatgcactaaagcatcttgataattacttgttaaagttcctggcctcaaataatcttataattttgaggacattttctgattgatctctctattattactccatgtaggtgcatgactatcttttgcatggaggtatttttacaaacctctatatcccacaacacaataccactacttgataaataattatttatcactcatctgtcactcatcaaaatctatcatttccacttattttctttaatcatctcagctcacatgggttccctctctcacataaagtcccatactacttattatttgtagcataatgtagtagttacaattacacagttttcatcctagccatcctgtatcagagttctatcatttattactcatgagactatggagaagtcacataaccatcataactcctattcctcatacctaaaatggaaataattatatctatttcccaaggtttttgtgagaaatgactaaaaccatatatgaaagtgcttacaactcaatagaaagcgggaaaagataaaaataaataaaaatacaactcaataataagacaaacaacccaatttaaaaatgggaaaactatgttaacagacacttacaaagaaagacatataaatggccattaatcacatgagaagatactcaaaattatattcattaggggaatgcaaattaaaccaccattagatgccaatacacatctggcaaaagctgaagttccagcaaccagaactcttatacattagtcagtcagagggtaaaatgataaaactccttcaggaaagagtgtgaccatttcttataaaactgaaaatatgtctatcctatgaccaaataatttcattcttatttatttaagagaaataaaagtatgttccacagaaagccttgtgcatggatgtaaatagcacctttatttataataaccaaaacttagaaatgcccaggtgtcaaaaaatagagaaatgtataaacaattgtggtatattactactttcccataaaaagaaacaaactactggtatatataatgacatagataaatattaaaaatgtcacaacaagtgaaagaagacttacacaaaacagaatgcactgtgtgattccattaatgtaaagtaatgagaacaggcaaaactaatgaagggtggaaaaggtgagaatagtggttgtctagtgtgggaggcactcctggctcacaagagggataaaggaacttgaaactatctgaggtgatgggttacaaggatgtttgtattcatcaaaatgcagaatatgtacgcttaagatttaggcatttaaatgaaagttttgccataaatttactataaaacaaaaacattggaaaataactataaattaaaagcagaaaacaaatcaatctattgataagcataaattagagtaaaataattaaactgaacaaagagattctcacaactgttcttagttcagcttcatgctgtttcaagagaaaactatagaaagattcaaacaaaagaaatggaagaagagttacaaagcagatattaaataaaagaatgttgaataagttaagaataaaggaaatactgtttttataccagaccaaaaaagatgtttaggccaataagagttactagtatacaagggtcattggataaagacaataggaatatttactaggaaataattacaattcttgatttccacgacctcaatagcataatcacaaatatttgaaacaataattgactgaattatgaagacattggcaaatttacaatcgccatgagagattataccacatctcttttggtagttaaaaattaaggagatggcctggcgcagtggctcacacctgtaatcatagcactttaggaggctgaggccagcggattgcttgagcccaggaattcaagaccagcctgggcaatacagcaaaactccatttctacaaaaatacaaaaaaattagctgagcacagtggtgtgtgcctgtgtccccagctactcagaggctgagataagaggattccttgagcccaggaggtcaaagccacagtgagccatgatcatgtcatggcactccaggctgagggacagagatagactctgtctcaataaaataaaaattttactgacaaaatatcagtaagaatcagatttgaacaacatgattattatttaatttaatgaacaaatatagaatcattagatatattcaatagaaaatatattctgattaaagcattcatgagacatttacactattgaccacccactaagccagaaagcaaagcaaatctcaatttgaagaatcaagattatacaacccacattttctgaccatcatgataatacattagaagtcagtaaaaatgttccagagaaataatagtagcaacgcatatggtccttgctaagtggtgggcactcttctgagtattttaaatacgttagcacttttaatccttgtaacaactatataaggtaggtactgctattatcatcccagtttcatagatgagcaaattgaggcagaaagagaataaataaggtgctaaataaccacacgtgcacacataagtggtggagctcagctgtggtccttggcagcatggctttggaggtagaactcttagccaaaataacattaggatcaaagaaaatgtctttatgtaaattagataatagatgagaaactttgatcaaactacaacagctacatattacctggaggaaaataaagagccttaaatatttgtgttagaaattatttttaaaaaatgactgacaatgaatgtgctaagcgtataaaaaaccgaagaaattgaaaaaagaataacagtaaaccctaaaagaaagaagaaaatgataaggataaaatcagaaattaatgaaatggaaaaaatcaagattaataaattcaaaagggtacctctaaattcaaaaaaagtggaaccaaactggaattttcccattggtgtttacattgcttaggaggcatgtatcacattataaactgtcctaagaactatcttctgtaattcacatatattcctgagctctctccttttcaggttaaatcaacacaatttctttagccgtctttactgatcctgctttctagcccttcactaatttccatttattatcttctgattttttccacttcttcttagtcttcttaatttatggatcagaaaactagctcagaaccttaataagaatccgaatggcactgagcatagttggaaaatcacttctgggttttacattataaatatttagaatgatcatataaaatgaactgcaatatgtttcaggaaactttaaaaatgttcagataatactaacggggcttcataagaatatcaccaaaatacagacttaccaagactggccattcattgtcactagttgcaaattaaatctgcaaacatcatcctcaaaattttacaattaattttaatggattatggaagaatttaggacagcctatccattataacaaattcctgaaacaatgtttttgtctgattggagagtataaaaattaccttgttgagtttgcctgtttacttttcaaaccaggtattgaaaattgaaatatagtcaccagtcagaagttgttgcagtaggcttcaaataagtttaatatacttattgctgcctttctaaaattctatgcaaagaaagcaatcagatactgaaataagtatttatgggcaaagattctcagtgcagtattgttggtattattaaaattcagaaacaaaccatccaaaagtacagctattgttaaataaattatagtatatccacacaagacaatattatgcatccattgtatttgtattttttaattaattctatggggcaatgtgtgatatataaaatacaaagagaaagtaaactatataaaattatatatggttgatacatttgccgatgaaatgacataatgattgccatttgcttcaaaataatatgtgaggggaatgaagtgggtgtgacagagatgaaacaagatggatcgtgaattgataattactgaagttgggtgttagggacacaaaggttcattacattattttttctacttttgataatgttacaaatattctataataaaggtttaagaagcctatatatacattgtggttctaattataaatctatatatacacatatatatattataatataactagtgttttataacatatgttcatcttgaagaagacatcaccaaaatgttaaggctggcccaaagtggttgatcattccttattcattaatacttttctaatcaaacttctaagtttataggcatcccaggtcttccaagatactactttaaaatgttaccttttttctaattcatgctttcaagtggcaattcatataattaagaagaatatgctgatcatcactctactttattgtttcaaattatcttgaactcttaaactcataatcctacataagatgactatttctaccatggcaatccctgtggttatttgttcaatgcccactgccttctgatgcaactggctcccagtacaccagaaaggtcctttattggctgagcacattgatgggtggttgtatgcagtttgaataaagataggagattattaggtaaaatagagggaaaagaaacctaaagttggataatgataacctagaggaaaggtagtcagaagctggggaaggtgaatgcttcttagtcctgagaagactaaagtgtaaagaatctccttggcagcatggtagtgtcagaggcctttgaaccagagcaacttcatcttaaataggggctgggtaaaataaggctgagacctactaggctgcattcccaggagattaggcattcctagtcacaggatgagatgggaagtcggcacaagatacaggtcacaaagactttgctgataaaacagattggggtaaagaagccggccaaaacctaccaaaatgaagatggcatcaaaagtgacctctggttgtcctcacttttcattaaaggctaattataatgcattagcatgctaaaagacactcccaccagtgtcatgacagtttacaaatgccatagtaatgtcaggaagttacactgtctggtttaaaaagagaaggaaccctcagttctgggaattgcccacccctttcccagaaaacttatgaataatccaccccttgtttggcatataatcaagaaataactataagtattatcaatagagcagtccaagatgctgccctgcctatggactgccattcttttattcctttgctttcccagtaaacttgctttcactgtactttatggactcgccctgaattctttcttgcacaaggtccaagaatcctctcttggggtctggattgggacccctttccaggaacaggagaacaaagatgatttctggagaacgtacaggtataacaaagatttttacagtaatttgttatggaatgtgcaaggtaaaagctttcctttgatgatgaaaagagtcaaactctgtaaaatattttaagagatttattctgaaccaaatatgagtgaccatggcctgtgacacagcccttgggaggtccagagaacatgtgcccaaggtggtcagggtacagcttggttttatatattttggggaggcatgaggcatcaatcaaatacatttaagaaacacattggtttggttcagaaaggcgggacaactcaaagcaggggcttccaggccataggtgaatttaaacattttctggttgaaaattagttgagtttatctgaagactggggatcagtggaagggaaatgttcaggttaagataaaggattgtggagaccaagttttattgtgcagaggactctctcagatagcagacttcagagagagagcagattgtacaatgtttcttatcagacctaaaaacttacctgcctttcagttgactgcctcctggatctagaaagaaaggaaggaaaacgaagggggaaggagattctctgtagaatgtggatttttcccacaagagtctttgcaggtcaatttcaaggtatggcaaggaaatatattttggggtaaaacattttgattttttcccttcttatcctatagtcagattggaaagtaagccacgatacacagggttaaataaaacccatctgatgagaatttatggtttgtagggcatgattccccagaccccttagaaaggaatttgggcaagataaaatcagatctcagtcctcacctccaaaataacattcagcacaatcaccattacttactgatgctttaggcgtgggtaaattttttctggagaatgcaaaggtggtgttgagtcctgagttgtttacctatggagcagtaatcagaaaaactgacatatgggatccatactaaataagtgacatttactgcaccccaaatacatcgagtcagtcataaaacctagagtctaagcaacaccaagccctcaaaagactaaggacacataacaattaacccatcattagtctattagtatacatacattaacaataacattttgaacctggagagagccataaaatcattcatttgtaaaccaaagtgtatctgagacaggtctcaatcaatttggaagtttattttgccagggttaaggacatacccttattaagaaataaacataaaatcaccgaaacagtctgtggtctgtctttctccgaagatgaacttgagggcttcaatatgtaaagggggaaagcgggctggaggggaaggagggagagtatggaaatacacacactgcaagaggaaaggggcagatagggtaatagtcaattaggtatttgtcttgtgcttggtaaattggcactttacataagttaaggtgaacactatgtagctacggggagatatttaaccttttatctgtagctatctgcttaggaacaaaaggaaaggcggctgactcagccttcagcttaactttttccttttggcatggtgaattggggtcccgagtttctactttcctttcacaaaatctaacctcctaaagccacccagctagttccagtcacagccagatataaaatcaaggcttttgactcagtgctctttcaactactccaaactgataaggtttactaggggaggtggaagagaaaaaactgagaaaatgaaagaaacggacagagaaaatttcattcattgataaaaacagatgacatctatcattacttcataaaagataccaaaaatcatatctattacacaattatagaaaaatatattaaataataggccttaccatagaaattgtaggagtccagagaacaataccccaaagtatggtgctttggcatgctgagttcttttaaattaaaggatatcaaaaggcctcataagcagccccagaaccaaggactttttgatctcctgtttctcactccaagcacagagtggaaccctctctctcaaattcctttatctgagctttccaaaaggcacagaattgtcttttgtcccccgccctgaaatttaattatctatggcaggaaagaagactaaggaatgtaaccaaaactggatggactttgtcagaaaatagtgtctgtctctaaagctcattcaaatgccaaagagaaccatttacaagctaatttctgtctcctggtgatgcaggatttttttcctccttagttcgggtaaaatccaggttcttgtctcacaaccaggaaaaattaggcacacagatccattgaaaggtaaggagagcagagttcattgggcaaaaagaaaactctcagcaaacaggtgagggagtcctgccaaccggctcccacttcacagactgaataccaggtcaccacacacaagctgaagacgcccgactcctgcccctgcataaggtgtcaattcctggtgactccaccccattctcccagtgtgcacataggcccccagtgcattgcaggcatgcccaggcaagaagaccctgtgcaggttcccttatctgcctcctgcatttatcactgggaccatttaatttccctaaaaatcatttacaatccctcaaaattgcctatatttcctccatttccctcccccaatgaagagggtatataagcttcaactgtctgtctgtttctttgagtcttatatctgtgggactctcatacccatgtatgtgcacaataataaacttttgtgtctttttctcctgttaatctgtctgtctattgtcagtttattttggcaaaatgtgtcaatcatcaaaacatcagagggaaagtaggcttccccacaaaacacagcaattctacacatttttacgtttgacattttcatcattatcctccctccaccattctgtctttattttttctcctattactgattttaggtcatgatctttacacttttgaaaaaaaaaatgagaggacagtcaaatatttttcacctcaaaaatgatttaatcaaatagcaagatttaactaaataagaccaatagtagcaataaagacctgtttagcattttcaaagttattttctaacaaaaatgttcacttaaacatactctggtcaatagtttatttattgcctgatctatgtaatccactacatttcatcactttgattcagttgcaagtccttttgttttccttctgcagcaccttcactaaatataaaatatatcagcacgctgagtgctctttatttacacttctgagtgactagagaaatttatttgattgcaaagcttaaaaggagcccaataagtcaggaaaaaaatgcacagcactgcttctctactcagactaatttttttctaatatatatgatggtttataatttgcagatatctttaaatatttataattcagcagggactccttattagttaagtttatttggaataaaaattaattttccaagatacttcaatttcatagattgttactgtcctttatgtcatatagcatgaaaaaatgtctaatgggacaatcacttgtattatattattaatcatgaataattgatatgtaatcaattcactttagttctgaatataaatatcccaccagccaaatgaatcaaattcaatttatcttactttttagaggacattttcaatgtaacaagaatgataatgatttctaaggaaaagatccttggattatgcttccataagatgcattcattcattcactgattcttcaaataaatattgactactctctacatagaaaacctcatgataggtccatatgacaacgcagagagagttgccaatcattgtggccaatagaaaactgtgaagtttcattttaatgataataccagtatgtcctattacacaaataatgatttcacattatcatttaaagtaaattaaacagaaaataagactatcataataaatattattttttaacttatactttctattagaagtaattctaccctattccttacgcaacttggtccaaaatttattttaaaattttataactctatattgaatccctactatatgtcagacactgctagtcttgaacatacaaaaatgttcctaagcctagctgtggagagagattcaaaggcactaatataaacaatataacatcatgatgaatgttttcctgtaggtatactcccatgggaacacaaatttgagtaggatgcagagaatgcaattcataggaaaaggcttctcaagggaagtaatatttatccaagcataaataagaaaaggaaaaggagaaggaagcggatcttcatatctaaaaacaattgcttaacccatggtaacctaagtctacttttatgttttcttttctcacattttatgttttgctcttacattatttgatacaaattacatctttaaacattataaagcaataaacgcagttttacaatttatgaaattgtctcaggggtatggagcttttgaggcagctccaaatccattcttcttttttcagtggctgctcagctgtgggtttcacagctaccatggttgtgtgactactgactttcaagattggggctcagaaaacaatgcctcaaaatgaaggccttagcagtagctcaaaagcaaacatttttatttgaccttctcctgcatgcctgtctctcagtcccattctcccgcaaggctagccatgaaaactagaatctctcttccccaaggtgggtcatagaaagcaggaccccttttcccaaaagccagccttagaaacctaaaaatagtctatgtaaaaacaggccataaagaaattatctaatctattttgtttgacattccagagggggccccatcccacacccagaaggaaggactgctgcacagagaggacaagaagaatctagacagacaggacttgctgggtttccccactcagttttttaacactagatcatattgttatagaaggtagttagtgagacacaagcatggtaggagagggtccactgcttcttcaccaggaatgtcaggcaaccatcaggtgatggtaaggtggttgttatacagtcttgctaaaataataattggtcgcagccagtgccaggaaaaggcagtctcccaatagacagataacatctgaaactggtaatcagcagcttcccaataagatctcaggagttgggtgagtgggctcaagcacgcaccctaagaggcaaaatggcagatgaccttcctctaggaacactcagttggtaaggaaaaaacatctcaagtgactatgtgtacaacttcagtaaacacactgtgcattcaacccctccaaagtcctagtaggtcactgtgcatctggatggcccaccgcaaggaagaatcaggatataagagatgcagagatgcagaccccagaagcatgctaatgaaatgtataaaatcctaagtcaaaggtcaaatcacatacttgatctctcaagtcacccacttggccctcttctaaatgtactttacttcctgtcattcctgctctaaaactttttaataaactttcactcctcctccaaaacttgtctgggtctctcactctgccttatgcccctcggtcaaattctttcttcagaggaggcaagaattgaaggttgctgcggacctgtttggactcgccaccactaacaatatccttttgaacaatcatatttctacaggtatgtccatacttcattgaatctcagcctaaaaatggataatgtatctttgtcttcattctgaaggccactgtgtatacacattgaataaatgtgtatgccttttctcctattaatcaatctgcctcacgttagtgatttttcagcaaaccttcagagggctggggtggggaaagtggggaagctctccctttgcccccaaacaaggctactgtgatcctagagagagggagatggaaatagggtaaattaaaacaccacaaaaatcattgttcttgtatcaattctgccatttttcttgttgcaagccttaatttccagagttctgaaaaagttattttgaccatttttgccagtgttctcattgcttttaaggagtgaattttcagatgtccccactctgccatttcaaaagtactcccctggggctatgcttttgaattacatttaggagtgaattgatttaacggagaacaaagaagcatctttaaagtaattgacttttcaatgaagacaaaagaattcatgcaaccaaattagtattattttgttcaaaagcaacatcttagaaagaagtaacactaattccatggtagttcacatacttaaatatattttgaatatttttatctgtacttacagcgagtaagtaaaaaaaaattaatgttttaataatggcaaatgtaccctttgggagaaatttaattgaacaaagtctaattaaaaaggtatttgatcaggctgaatgtatcatcatttttttatctaagccaattgatggctataaagtaatcagggtaatatttgcacttggatcataacctaactacaaaaccctcattccaaaagagtaactttccttaaaatgttataaccaatggagaaaacattggaataagcttatagcattcccagtggacatatttggcttaacaagttctatagtgagtgttaaaaatattgaaaaaagaaaaatagctcagagaagtctaagctatgtgaggaatacaaaatttatcaagcctggagagacataagacttcagtcatcccctcaccccctgggggtggcacctatgcccaggggtaattgtttaaaagcgtttttgctcctgactagctgcctcacccattatcttcatgttcctggaatttgtgacttcttcaagacttactccaaatagatatttactcatttctctgagctatcatgtatatagaaagtacacgttattaaacttctgtttgctgttctcatgttaatgtcttttagacattagaagttttagaagacactgttctcatgttaatgtcttttaaacattagaaattagacatttagaagtcccaactaataactaatgaaaggtagaggagaaaattgtttttcctcctttacagcattgcagagctagctatgggcccctagaaatcatccgtaaacttcacatatttaaaataaggaaatagacggctagagaactgcccaaagtcacttagctagcagagattttacaaaacatcaatgggcatctaagaagtgcctacaatacatcaggcactgggctagacactacccttcacaaaataaaactataagttgggccaatgacattcagtctactgctctttgcacaacttcacactgcataaatgaataaattctcaaatagccatcaaaaatgaaatatccagaggaggcagtctaaagaattacaatgaatttttaaagtaacacttgttttgtaaacaggaaagtacatagaaaggaaaagagaaaatccattctatataaaatagaaaaatatgtttgtactgactcaattatttaaaattaatattgtgtggcctaggaatatgtttttatataattaatgtttgttttttacaaaggttcctacaggcaggaaatgtgtttgatttttgtgtatacttcagatttcatcacaacagcaatataatgcaggactcaatgcaaagtaagaaaaaacaccaggcaatcagttttggttgctttttcactaacaaagcttgttaagaaaagaagagcatttttattttttataaatagaggattttagtgcctattttggaatagcaggtagtattccagctgtttggggctgctttgggctctaggcattttaaaattaatgggctgggccaaacaaagagtgtattttcattccacatcaaatgtgtatgctggtttctagaaatacaatatgtttgtgcaagtgtggcaacatttatccttccaggtagtaaatgaagacatctgccttctcctagagacttagctctccaagtcaatttaaagaaaccagcaaataacccttagtgactcttaccctcacacagaacaagctgatttctcatgacagctatattcaatctatgactaaataatgccattttaaatgaccatgtgtgggaagtaaaactataaagtgaacatgtgctttagagcctggagctcttagttcaaatcccagttctgtcatttactagttgtaggacatttttaaaatctgttaatttctctggatggtcagtttcctcctatgtaaaatggagacaatattacctacctcacagggttaatgtgaagattacattatatagctcatgtaaagcacttagctaaatagctggcacagagttgacacttgatgaatggtgccttttatctgccccctctgcaattacttacttaaagttatctattatttaagcatctttccattcttaccaaacttaaaattggtacccaaaaaaatcacctaatttttctcctgttgtactaagtagcaaaagaaaaacattcaagaaatgggaaggccttcatgatacaagttttcatgtctgtaaaattaactctgcattaactcctgacttaaaattctacaacacagaactacaaaattttaaaagaacagaatattaatctagagttgatataaaaatactagctgtctcaacttaaggcatttcacaagcctgagaattatttctgctttgactttgcagctctactgaaagaaacccttaccctagctgcaaacctggacagattcttgaacacaatttcttggcgcttcctctgaaatccccctagaagcaagagcttctgctgagcgactccatggtgactggaacatgaaaaaacatgctgggcccgagcgcggtggctcgtgcttataatcccagcactttgggaggcggaggcaggtggatcatgaggtcaggagttcgagaccagcctggacaataaggcaaaaccccatctctactaaaaatacaaaaattagccgggcatggtggtacacgcctgtagtcccagctacttgggaagctgaggcagaagaatcacttgaacccaggagacggaggttgcagtgagcccagatcccaccactgcactccagcctgggcaacagagtgagactccatcttgtaaaaaaaaagaaaagaaaaaacattcttacagattgtctttgtgatagccaaacccattccagactagtcaatggttttgccatcactttcgtgcaaatattttctaaatatctttgcatatagtatgatgtattataaagacaatcctctggaactattgtgtatgttcaccataaaaggtactccttatgcacatatttctcacactgactgcatacaaatgacttgaatttatagaaggatttttcttcttgtagccattcatacccagctcacagcccaagccaatgtgcgtcctccaaatgcaatcagatgatgtgaccagccttgaaacgctcatcagacatgttttctaacatatattcttggtccagtctaaacttggatatttggaaacagactacttagaacaccagcatttgatattgtgttcaaagattgcagaaaaacatgtagttataatcactctagtactctccctgattatataattaggggtgtagttttagtcttaaaagagtaccaaatagactttgagtcagtaaaaagaacaacttttactgagagtagaagagcatctttgccatcaaatatgagcttttgcagtcaatttagccccttctctaattgacactgttcataaaagacatttaaaaccatttcatgtattgttaatatgcacagtttcaacaccattacataacccatcaatgtgaagatcagaggtttataatcactgaaattgattagtccaatcctcaaaacaaatagcttactattctgtaaaattttttccctggtgcaagtggaagtagtattgtaaaatgtctttgaaatccaacaggaatacagatttctcctgtaggacacagttttgcaaaaattgctttaatcattaagtaaagttaagcttgatgaaaaatctttctactacacgtctttgagtcccaacaacagaagcacagatgatggctgtgtgaacttctatcagtttgcttcaaaattaaagaaaatcttcttagcatacaaatcccaacaagtagcctagcaccacttttcatttattaccaatgcaaccaatttaaacagaacttattcagtttataagatggatatcttgtcaactgctaatcataatataaacaatgaatttgtactgcatattatctgtgcattttttctcttcaaataagattgcaaccttaacagaaaatgtggaacaaaccagcttccgcaacatagttctttctttaacaataacaacaataaaactatgctaaaactacactgaagctacactacaataaactgcaaaaaatcaaaagatccaagcactaacactgagtcacattgtactctggcacctgtaataagattacctccttgtgacctgctcaaattctggacccaaagaaagttttcagaaagtttttccaaaatcctctgtctgtcacccataaagcttcattcaggtactaaatgataggtaagtttagtagtgtagtcctagctacatgaaaggccagggcaggaggattgcatgaacccaggagttcaaggttatagtgagctatgattgcaccactgcactccatcctggcaagagagcgagatcctgtctctaaataaataaataacagataaatgatttacaaattttttatcaagcactctttagaaaaacttcagcattcacacataatatatgtatttatacattatatacaagttctaatctcagcctttatgttaaataattactaaactttgttttttacttagataaaaagtaattatccgtagaatttctaatatttttcagatgttccactggatcattgtgcatgccttctgggtattcaactttggagagtactgtactatatgagtcaggattattagacagaaaaccaattaaaaaccttagatgtaaaaagagaagagagaggagagaaagaaagcaccagttgcaaatagcctaagttttaaagtacatcaaacatcgttatatgccagagcttcacataaattatcttagtaaatcctcaaaaaaggcattaaaagaggtatcatttttgctcttgtacagatgaggaaactaggatcagggtaattacatccaaggtctaagtgtcaaaacaaatgattgtcagaggacaggaagaaaataaaagggaagccgttaatcaaacatttggccctctcatatcccaaaattctaaagatctcttaccacaaagaaggcaaatctaggaataatcatctaaaacatgttcagtacatgtatttcaaggctctagagacaaagggcaaaacatactaaattattattagtgcttgagaaactaatcaattatcttttgattgcctgtcatttcttaagcaggtaacatggatccaacaaaggaaggatggatgaatggatggatggatggatggacggatggatggatggttgatggatggatttatttatttatttattttaaagacagtgtctcaatctgtctcccatgatggagtggagtggctcactgaagcctcaaactcctgggttcaagggatcttcccacctcagcctcccaactacctaggactgcaggcatataccacatgccaggctaatttaaaaaaaaaaaaacatttgtagagacagggtctcactgtgttgcccaaactggcctcaaattcctggcctcaagtaatcctcctgccttggcctcccaaagtactgggattacagatgtgagctaccatgcctcaccaaagtctttagaatctctattagcagtctttagaactgtggtatccttcatacaatgtataaatgctagcagctccagtgattccctgcttacagtgttaagggatggagtaatacctgctttttttattttattttggtttattggagacctgcacaacttgtgtggcatgtagcaccacaaatcctagtctgttatgtaaagagaatttaaacaaattaatcacaaacattcatgagcacatatgcttatttgcatgactgtcttgtattatagcctaaaagttattcatgtcttaaaggtgtagaaatactgtgtctttcatcaacatagcctgagacaattgagaatttaataagatatgcaaaaccataaaaatcatggctaatatttatgcaacttttctatgtgccaggatgtgttctaagcattttatgtgtattatcactttgaatcttcacaaacacctcataaagtagatgctatatgtgtccccatttccaaccaggaaaactgaggcaacaagaggtaagaaatgtgaccaaggttacatcactagcaggataaccagatctttgactcaaagatgtctgactccagagcttcctccaagaactatgacagacatacagtaagagagttcaaaatacagcaaattgttaacaaatatgtagagcaaatggctaacaatatcaattaagcactctgatatatctccaagactagttctgcaacccctcgcagctatacatcctaaaatattctgcctcttacatgtctcagaaattaaaagaagattctgctaatccatgttcagtctgtcacacataattgatgtgtgggtgatgttgagtttgcttatttgttcaccctttcttatgtaatataataggtgatgttacagatgatagaaaaacataaggttgaaaggatggactccggagtcagatgcacaaggattcacattgctctctggctgtttttggctatataataaattgatccctccaagtctcagtctccccttctataaatggagatattgacacctgcctcattaaatagctgtaaggagaaaatgaaataacatatgtaaaagaaaataatacatgtacaatgcttgggacgtggtgagctcccaaactatgctagctatggtaaataaaaataaccccactaatagtgacacagctggtgttaacagtgtgatctatggtacatggacacagaagagatagttaacctattgagtggctaaaattgtgagcttggtgtgaaagatgaatgatctatcctggtccactgattttctataggtctccacagcacttgctcacccacctctttacaaagcatttctcctctctctagcatttctcattgttatctctaacaagtgatttattttaagttcatcttttctcatttcctgtgacctgttcagaagctcatgtacatctaccattgtgagcacccaaatagtttgttatctcctcacacaatacttcatagtcagctgattcactggggttcgttttactatgtaaccatctaccataaatacctagattgtttaaaaggccacaccgccactcacacacaaaaagaaagctttgcatattactgtaacctcttcacatgatttactagtgttaacacagctttctatgaaaaatgaaagataaaagttgtagagaccaagggaaaactccttcagcctctaaaggttcatggaaaaatcaactcacaaaaggcaaattaattacagaaacggcatacaaatgtatttaatgtgtacatgagagccttcagaatgaaaacccaaagatgcaggggaaattgtccatttatatgcttcagttcaacaaagtatgaacagccatactcaaataagattggacaaaaagtttactacctaatgctaataggttgagtggggaaggtctgtctagactcttcttggcctctctgagcatgcctttcttccttccgggtatggggcaggactctctcttgaatggcgggtgggggtcttaagacctacagtaaaacaatgtcagttagataatttctttatggccagtttttacacagcagggcagagagaaagtttgagtaatatttttaggtgttatggggggctttagggaaaagaagttctagtttctacgacatgccctggggaagagggattctcatttctatggctggatgtaggtgaatggggctgagagacaggagggcaggagaaagtcaaagaagctttcacttctgagaccttcattttgaggtatttttttttccgagtcccaacaaagtaaagtgggaatccagacaattctccacaatttcatgtaaaacaataagcgcaatgattgtaatatactgatctacttctcaaatttaaatgtcaaatgataccacatcattttactttttcagattccataattagtccccctcccatttttatatctataaactcctacttggctattttctttgaactgctacaatgaaaccatactctaagggatagaacaattttatcaacgtttgtaataatgaaaactttgaaagctttagttttacttaataatcagttaataaaaagccataaagctgttaatacattttagattcaagtaaaaatagtaatgactttcaaagagcaacatttctgattggcaatattaaataggaacaaatcattgtggtttgagatgtgtttaatgcagaaagtcctgtgtgctcaccatgtatcacaattaatgttttctggtaactctaatgggctcacagggatttggaagtttggtaactatcagcacttgaaactttttcctctttgtccaatactagataaataaaccattctagtttaggatattgaatcatataaattcctaaagagaattagtagattaagaagagtcaataaagcagaaccatcagaagttctctaaatggaaagaagttataaatactacctatttccttgttaatatcaggttacataaaaaaattattcctgaaaataaagttgctaagcttgatcaagtagactttcttttttataagtagattagacttttcaacctaatgttttgaggaaaacatctccaaaggtcctcttagaaggtagttggaaggagccctagtaaaagaaaaatctataaagcttacagataaaaatcagcttaaattgtgtccatccatgaatgtcaatttctattacagggcagaatttaattaattttgtttcatttaataaatattctcctatggtatacaattccttactagacactatatcagatttctaagtagttcaaagtattaaggattacttatgactggaacatgttatcaatgtacatattaaattttctcctccttctaaattacacattttattttttttattatactttaagttttagggtacacgtgcacaacgtgcaggttagctacatatgtatacatgtgccatgttggtgtgctgcacccattaactcgtcatttaacattaggtatatctcctaatgctatccctccccctccccccaccccacaacaggccccagtgtgtgatgtcccccttcctgtgtccatgtgttctcattgttcaattcccacctatgagtgagagcatgcggtgtttggttttttgtccttgcgatagtttgctgagaatgatggtttccagcttcatccatgtccctacaaaggacatgaactcatcattttttatggctttatagtattccatggtgtatatttgctacattttcttaatccagtctctcactgttggacatttggcttggttccaagtctttgctattgtgaatagtgctgcaataaacatacgataaattacacattttaagtgctctaggttcaattggctctgagcatggtaaacaaactgcagtcactaaagaatctccaaaggcttatctaataccagtcaaagttatagattctatttggaaggctttttcatcctacaaagaggatgaggtcttattcgttgtccccaacacctcgctttttgagtgttcgcacagtgtttggcactcagtggcactcaataactgtttgctgaaaaaaataaatcaatgagtatttagagacccaaatatatataaggaaatctaatactcgagtaaatataccaatagacacaagatataggtggggaaaaagactatgtgttgctacaatttcagggtaattacatacatacaatcattcaagaatttcaaacttaaaatgtattcaactacaccaagttaaccttctcaataatatgttcccttctgttccacaaattattcttaatttgattttttttaaaaatcacactatcaattcaggtaacatttttacaaataaaatgttttgatttttaagaagaagaataatgactacaaagctatgtatattgtcaaatcaaataaatttatcatgcacctgaaacttgcaccaaggaaaggaattctaaaaaagtgactccccagttctcccactgagacaggagttaaaaagatttaagacactgacagttaaatcaatctcagtgatctcttttactgggggaaagtactgatttgatttataaaagtttaatttcaaattaaaacagctgttaatatcctttaccaaccattattttgttatacgtggcaggaaaataagcagatgaggtcatctgcctagactgaggtgttgtgattatttacagccctaatttttgttcagtaattggtaggtacagttctaattcttgctaatgactacgatatattgctcaggcaaattagaggaatagaatgttctgttactttagcagtattggtaaaaagtgacacaataaaaatgagtactcgttgaattaaatgccttcaacaacatcataattcaccccaaagatgctaatactaaaaacacatcctgcccccatgaagtggacttcagtagaatggaatttctgtatttatttagcattggcttctatcactaattaccccttctttaatgtaattttggggcataacgtagtaagtggttcatgatcactaattaaatgcctactatctgtgagaaaacatattttaaattgttctcttgaaataaaaatgaaaatactcaaaagaaaattctttcttaaaggtctcagaaagaaagcaggattttttaaaagttaattcatgacaacagatagatcataaattgtaaaattataaagccatttttactggaatagaagaggattagcagctaaggaaatacagtcacgggcatggtaagatatacaggtactttctaagttgcttcatttgagtcacgtgggaattccaaattgaatcatatgggaagttaggtcagagaacattcttactccaggagtttttcaaggataatagctgagacctgcttatatataggccataatgcagctatttaaagtaaataaagtcttcaattcctaaagtggcagattccataccaagttctaatgtacccagccactcacagctaaagccacaaacaaatgaaatcaataaaatcaggcagtaaagccaacatctggggttgctgttcattgcctaaaagtgtcaatgtgggttttaattagctggagtaagaagaataagagttgaataaaatcaacttaaattagaagacacacacctgtgatgcaaatattttattctgttaaatcttgtttattatactacttatcacatttatctcagatgctgatacaaaatgctatgcaacaggctttgaaaactgtaatgtaccatacacatgcagggccactacctacggatgctcaggatgcgcagttcattgcagtgccacatctaagggagggtccatagtagacactgtagatatcatgaatttttcagggtgatcaaagttaaatgtctcagtctaacaagaatttctgacaaaggtgaagtgtgagtaagcaatgaccctgtaagatattatttttaacccaaaatttatattatctcagcaaagaggtttctggaggaagcaaacacagttgaaattatagcattttttttcttttctctctaaaatattattagatgctcatttaaggcaaacaccacaatgcagtacagcatcatagcctaacagagcattatcgcctacctagctctatggctaagcatttaagaggtcagaccatcattctacaaagctagctgtttctgaattatatacatacagtaaacccagtaaattctgtgggcttgaaatcactaatgccataaaaaggtctgttaattgaaggtgattttatgggtataccatggagatggataaaatattttataagtccaaaaatggcagcgattttagaagcactgtaagaaaaggcaaatcaatatttggactttgcgtctttctttgtgaggacaaagcatggcatcctccaggttgaaaggggtttaatgcaatccagttgtcacttggtagttggatgaccaatgatgctgtatcaagggttcagtgctgggccgggcgtggcagctcacgcctgtaatcccagcactttgggaggccgaggcaggaagaacacctgaggtcaggagttcaagaccagcctggccaatgtggtgaaaccccgtctttactaaaaatacaaaaagtagccaggcatagtggcaggtgcctgtaatcccagctacttgggaggctgaggcaggagaatcgcttcaacccgggaggcagaggttgcagtgagccaagactgcaccattgcactccagcctgggcaacaagaatgaaacgctgtctcaaaaaaaaaaaaaaaaaaaaaaaaaaaagagttcagtgctggtccctgatcctagcaaattaaatagtcagcaacttgttgaagtcagatcagctttgtagaggaaaaacccatattgttgagctttgtatgacctctagtcagtcaccacagccacattgtacgtggactctctgaccaagcaacagggtagctggaaaaagttgactgacattcacagaatgagtcatttgaccacctgaaaactgagtgtcccatttactgtgaatctctttggtaggcattaatgtgagacaggaatatcctcacactccatgacagttccaagaggtgtcctccagatcctctttgtcaccaacttcacaaatattttctttccaactccctgaccagccaatcagtttgctagggaccatccatgaattactgcatattgataccttaggacatctttacttctataggaaattaacaactagatgtagtgctcagagttcagcccactggaaggatttcccttcccactgtctttcacggtcctccctgcataggttacacctatcccctatagctggtttcagtatactatgcaatccatccataaatggaccacatattttccttctctgttaacatatcataggaaattccccacgaagccatagatatggactgaagaagaggcagagaaatagtagaatcaagtaccatgggagtgtaaatcacctgcttgtgcagtttacttggtgggcattctgggtctctcaggctgctcttaatatgccacatctgattactactggaatgctcttaggcacatcctattttaaggttcactggattcgataacaccttgttcattatggacaggtcaggtcacatactttgcatcctgcggtcatgtagggtccagaagcaagccagaaaaactgctttttaaatggaaaatagttgttggcagataagaaatctggccatgattctcctttgaggtttcttccagaaactccaaatagtaattctgtctatcgcatacatttctagtacattgagcctgctgggccataaaattaatgaggcataacagtcattggaatggtaagatgtacaagtactttttaagttggcttcatctgagtcacatgggaatcccaaactgaatcatatcggaagttaagtcaaagatgatttttactccaggagtttttcaaggataacagctgagaccatcttatagataggctgtaatgcagacaggacctaaggacctaatgcagagaccttcctttctcctggattcactcaaactgccagccttagcatttatccagtaaatggtcagcagtagcccatccgaaggtaatatgtattgcattcaaaatccgaagtgtctcaccaagcattgtgcttgatggtggatggggttcaaggttcaggtttaataatctgtttttcactttagaataacctgctttagtgtcactctaatcctagaaacttcactgatgtggttagcccttcaaattttacaggatttatctcccacactccaacatgcatatatctaaagttactatagtacttgcttcttcctgcctgttaggccgaattagcataacgctaacaatttaatagtatatttgatgttctattgggtataaaagaaaccaaagtccctctagattatgagtgatcagctaggtgttacttatggtaaacctgtaaagatatactgttgtccctgccatgtaaatgcaaactacttctgattttttcatatcaatgttaatggaaaataaaacaacttctaaagggctgtgctagttagttcccataaatgttgcacaactggaactatatgtgcaaatagcatcacaacctacttaagtctgcaaaaatatactctcatgctccatgacccacatgttttgcatcagccaaacagtcaaattaaacaaatatgtagtaggaatagtcactcttcatatgttgcattttttttttttagacgaagtcttgctctgttgccaggctggagtgcagtagtgcgatctcctgggttcaagtgattttcctgtctcagcctcccaagtagctgggactacaagcacgcaccaccacacccagctaatttttgtatttttagtagagatggagtttcaccatgttggccaggatggtctcgatctcttgacctcatgatccactcgccttagttatatcttttatggtggtactaatctctgacattccctcaggaatgtgatgttacttttggtttactacctcagctaggtgaaaaatgtcattccaggagcttctgcttggccctttcttatcataatagccttcattacatggatcaagaaaccaacgtgttgattccaccagttactaattatatctattctcattatatattctgagactaagaaatgctgttagatttagaatatgatcaagatctacgtaaatctctactctgacttttaaatactatggtggcatttagagtctctggggatcagaatgaatttaaagccagaatcgaataactcagaagttctgagtattatttccttttctcccgtgtaaagtcaccctggtagaaggctgtaggattctttatattgtgaagatttctctttcccactggctttcagggtcatccccatatggggttttagtgcagcacctatccaattacagctggtctcagtatgccataaagattcatccataaatcaggaccacacagtttcctcctctattattatagaaatatgtttagagatggcttggaaaaaatgcaaaatatacagccattgctacattgcaaggcccttttacaaagagacctgaccttttcctcaattgaaaggacctaatatataaattggcatacatctgaaaacactaagttaaattgtttctgcccacaagacttgacataaggcagaatttttctgcctatatatgtaagacagtacattggaaggctgcacatgtatttcattcttagaactacatcatcagttagctattgctttagattaatggttctcgaagtgtcatgtccaggccagcagcatcagcattacctaggaatttgttagaaataaaaatttttagactccacttcagacctattgaattagaaattctggaggtggggcccagcaacctgggttttagcaagcccccaacataagtctgacacacagtgaggttaaaaaaccgctccccccacaaaaaatacagaaaagaaaatcattcccatagatgcttacaggtcaaaactccatccctgtggcttgttgtaatttcaaacacctcgtttgtaatgattaagggccaccagctggtctccatcactgtcaaaccatcatgaatcctactggatcaggaaactcagttccattatggcataacctacagtcatctccttcctacagaggacagcaaccacagagctatttaacaatgctgttatccccctcaccaatgcatattatagtgctttcatcaaaacagcatcctctggccttcctagggagtacggttaggagttggctgatccattctagcatttccgtttccccaagcctgtgaattccttcctctagagtaggtcaggtaatctcaaacatttctaccttattgactataggtcatcattgagttcaggcttcaattaatatattcatagactattaatgcctctcccaagtgctcagaccaacatattaaaccctaaattccaggtgagtacaccaatgtcaacaatttagcctgatgaacattagcattcactccccatgtatgccaatacagactggtggggtcttgaccttcttgacctctttcagtgtataaactgtttctcctggaccaggccttgtaccttcccatctgggctatgttgagtcaataagaggtggcaaagattggtcctgaggttaatcagcatctgcctgtgagacaggtaagaatttttttatgtacaatattttttatttaagttttaaaataaattttattgtataaatttaaggtatacaacatgatgttatggtatgttttgtagcaaaagtaaaatacttttatacactgagtagccaaatcccttagtgagccaggaggagttagatttagggccagaggctcctcagccatacctggtctgaatctggaagagatgggaaactctttcaagtctgcagtggagagcttcgtttgtccacacatgtccttaattgtatgtgcctagtttttaaattactccttttttctatttaacttcctgagagacataagaagaagccagggactccacaatctttacaattattaaaaaccacaatgagacatctcacctcatacctgttagaatggtttttatcaaaaagatggaagataagtataggagagaatgtggagaaaaggcaacccttgtacactgtggtgggaaggtcaattagtacagccattatagaaaacagcatggagagtcctcaaaaaactaaaaatagagctatcatatcatccagcaatcccactactgggtatgtattcaaaagaaatgaaatcagcatgtcaaagaaatatctgcactcccatgttcatagcagcattattcacaatagccaagatatagaatcaacctaagtgtccatcaacagataaatgaagaaaaagtggtatatatatatataaggaatgcaattttgcctttaaacataagaaaatcctggctgggcatggtggctcacgcctgtaatcccagcactttgggaggccaaggcgggtggatcacgaggtcaggagatggagaccatcctggctaacacggtgaaaccccgtctctactaaaaatacacaaaaattagctgggggtggtggtgggcgcctgtagtcccagctaatcgggaggctgaggcaggagaatggcgtgaacccgggaggcggagcttgcagtgagcggagatcgcgccactgcaccccagcctgggcgacagagcgagactcgtcaagaaagaaaaaagaaagaaagaaagaacgaaagaacgaaagaaagaaagaaagaaagaaagaaagaaagaaagaaagaaagaaagaaagaaagaaagaaagaaagaaagaaagaaagaaagaaagaaagaaaatcctttcatttgcaacaatagggtgaacctggaggacattatgttaggtgaaataagccagggcacagaaagacaaataccaaatgatctcatttatatgtggaatctaaaaaagttgaactcacagaagcagagagtacaatgagagtacgatggtagttacgaggggctggaggaatgggggattggggagatgttggttaaacaattcaaaatttcagttcaataggaagaataagtcaagagatctattgtacaatatggtgactacaattaataagaatgtattgtattatgtaaatcaataagaaaatagattttaagtgttctcaccacaaaaatgataagtatgtgaggtaatgcatgtatcaattcgcttgactgagccattctgcaatgtatacatatttaaaaatgtaatgtttatacaataaatataaacaattgttgtcaattaaaataaaataaaatggtaaataagttatcactgacatacaattaagaaccacagccacttgacctccaataatctatcttccatgtacacttcatccccatgttaccaccagtgataatctgagtaattatgccacctcctgccataaactgcccatgtcccattttcttccgctgtacactttgaatacatgacaaaactaattccggaatttcatttttggttctgttgactaggaacatttttggtaaagtgggaaagagtactaggcagggtgccagcattaaacagatggtataaccaaattagaataattgaaaaaggattgaataaaaggacaatttaataaagctataggcaagggacaaggaaaacataggctctttaaatgtggtctctgaaccagcagcaccaacatcacctgggaacctgtcagaaatgcaaattttggacctcacccgagacctattaaattagaaatcctgggagtgaggcctaaccatctgtattgtaataaactcatccaggtgattctaatgtgcaccaatgtttgagaaccactgacataaggtataatgcagtaaccaagtgctaatagctgtgaagctgttaccaatcctaggtccaaagagacaagagaacagatccgtatttgaaaccagagaaagccatagagacaaccaccttgagagaatcagtgacctttggtcaagagacccaggctaccctaggaaacccaataacaaggggataatataataaataacaaagtctcattttctcccttcttccagttgtcaacctggactcccaagtggccaaattcaaccagaatctagaaggcgagggaaccagataattttgtacattacagccttccaggctgaagaagaaagatgtatctgaaggaacaaatagaggagatccggcatgcaggcctaatttgcttttgttaacacacccaagttttgataaaactccaaaacatgtatttaaggaagctagaaatttaaaatattttgcaatttccatggcaagaatggtttctcaggaatggtcatttactatttaagctaataactagattccaataagaaagttcttttatggttagtgaccaaccccttttcttgttccctataatacagtatattgtagatattaaagaaatgtcagggattgttactattattcattttataatcacctcctttcccctatttagatatttaagtctctccttgtttccatgccgcatctgctaagtgaggatctaacctgtcactgaattctcctaggatttctgttcatatcagaacccttccctcttctgaatgccataatctaagctccattcacccacaagctacaacctactgacttacttaattcctttctcttttataagctatatttctttatttgcatttaatcctatgtaccgttttgggcttactcttgctttcagctagacaaactgctctagcctcctccttgttcttagttctatactacactttaacattcgcattgccttgatgcttgagatgtaaacatatataatgtggagttgggcaaaattaagggtctgcatccccattattgacttttagacagcaccacttcaccgtgcccctatctccatctatttctattatacaatgcttgtatccatctattcagaatttgtctgaatgtgaagtctcagccatccttgtcaaacccatctctccataggcacttcactatataggacaagtacatacacaagaataagaagccttgtttataattatagactgctttaccacacacattctcatcaatgtttcatctttcacgacactgataacttgaattagaaaggattctggacagtcagcagaaacttgttttaaactgagctttgttagaaaataaaagtaagactgaaataaatattatctgattattatgaatgtgtccctcaaatgtgtcctgcaaatttacctcttggctttctctgaaatgaaagaaatctatttacaactatttttggttttttttctactaaataaaataaaaggtgtatcttttgaggtgttggaaggatcagctaaccaatctcacccaatcattacttggtatctgctacgtgtctgacgttatgctagttgctattgactcaaaggaaaaaggaaaattgtcctctgccttcaaagggaaacaaaaaataagcaggtagttatagttattagtatttcatcaaggtacaaagcaggttatgtactctagactctgtgatcagagaaaggctttctggaggagacatcccagaactatgacctaaagagtatagtaagtcaagcagaaggagtgaggataagggaagaggaggaggtacaaagaagaagctatatataaaaaggtataaaggcattagaaaatgtgaggtattaggctgggtgcggtggctcatgcctgtaatcccagcactttgggaggccgaggtgggcggatcacgaagtcaggagatcaagaccatccttgctaacacagtgaaaccccgtctctactaaaaatacaaaaaattagcagggagtggtggggggcgcccgtagtcccagctacgtgggaggctgaggcaggagaatggtgtgaacccgggaggtggagcttgcagtgagccgagatcgcgccactgcactccagcctgggtgacagagcgagactccacgttagtgggtgcagcgcaccagcatggcacatgtatacatatgtaactaacctgcgcaatgtgcacatgtaccctaaaacttagagtataataaaaaaaaaaaattaaaaaaaaaaaaaagagagagagacaatgggaggtattaaagtaaaaagtgaaaagtgaagaggaaaagtctagataggtatgtaggggagaaataaagaagggtcttgtaccctatgctaactatgctaaaatctatagagaatcatggaagaattttaaatcagggagttgaagagtaatattttcctttttaaaaggtcacaatgtgaattgtaaaaaaataaataaataaataaagctagattggaggggcaagactagaagtggggagataagttaggataccattacagttaaaaaaagaaaaaaggatgaacctgcactagagtggtagatgtgaaagtggagggaagtagcttcatttgagagattagggaagcagactcaataggacctggtgactatctggttgagtagctagaagagatatcagtggatgctaatacaggactgagctcagaaagaaaaataagcaaaggtgaccaaaacagaatgatcagaaaacacaagaaaaactattatggcatttcacacccaaaacaagcgtttgaggagatattggtctatggtataggttgagtaaatgaggtctgaaaaagaatcagtgtgcttgacaagtaggaagtcagtgaaatttgccagaggagtttcagaagtggggtggaactagaagtcaaataagcaaagtgaggagaaaataggaggtgaagaaacagataaagcaggtgcaaatttctcttttaaaaaagcttaacagtcagggatagaaagaactgatagcaaaaaaaaaattatagagcccagggaaagtggtggccttttaatttttttagatgggaggaactggaaccttcatcagaacgagctaataaaagataaagtttgggaaaaataggattgtattcttcttataccagacattggggtatattgagtaagagacactactgacacaaaatgtcttttaaataatatgttggaataaactcccaaaagcatgaacaatattccaataaagttatgcaagttgcaagataggtgattgaagaagagctctttattaatcaaagaaaactctcaggtacacactgcctgacatccttaaatggtaacatgtagctaaagatgacatccaggaaccttaattaataaaaccaggaccataaacctcaggaacaagagttggaaagaagttttacagaggaagtttcaaaaatggcaatgagtggccggaaaaagaggaaaaatcagcatgcgtgtgctgatgatattttaccagctaatagctcctcagaatttcttctccatcagtctcccacaaccccagatcatcacactgcattggaccattttcttgatagctttggctctgagcctctctagagccctctgctggtggatttttttaaaaaaaaatacaaggattaaggattttacctgacttctagatcccatccatccaaggtaaaacccttcacatatctggctttcctgggaagagtattccagaggaaacactatttccactttaatgtaagtgttcatgggaagtgaaagtaaacattttgcacacagagaaaacctatcaaagactcagagcaggagataaaaaggaaggaagatacaaaaaaatgtaaaaatcaagaagggaaagttatgcattgtgggtgactgcaggttctggaaacaatctacctgaattcaaactctggcattatgctttaacagacacatggctgttaacaagttgcttagtatttttggacttcattttcctcatcaggaaagtatggaaaaaaatatcttttattatgttgattaaataattaataaatgcaaaaaaatgcaaatggattctattgctacattttcggttctctcttcagtgtcttatagaaaagtaaaggaaatcaacttgtcaactagcagaaagcagtatctaataactgatcaaattatacgggcagtaatgctaattgattaaaagtcatagcatatcgtcatatactgagttccaacagatggcatgaaaagcctttgcagtcctgaatctctgccttctatacaacatgctactgattaattgtttgtttgtttgtttgtttggttggttggttgtttttacctcagcaactaaatatcccattcatataaaccacagcactagtatcagagacccattcagtgcttgtctagtctaatttcatgaaggaaaacatcatgcttatttgaagactatccttgaaaagctacagtggttaatttcagtattctagatatgtcagtatcagatattgagtcctgctttgcctatcacctctttctaagactgagtgtacaacctatacccccaaacctcagactgtgctccaagcatctcaaagtggccattaggtgaccagtacattaattctcgtgtacattaaattctgtacaatgggtggaagtggtaagtggctaggtaaatcagatttcatcactcgggacctataaaggaaaaatatggatgaaattaaccagtggaattaggaattaacacacaaaaagaaagagtcttattaatggtagagtgctagagtcaagatccatgaaactaccactaagaggaataacattatctggtccccattctcagaaggtcctgtgggattctgctactctaccctacatgtgttctcataaaactccaatcattcatgttctccatgacaggaaattgccaaactagcacattatagcatttaattatcattccttcccctcttttggcctacatacttactggatcatcctttcaacattcaagagactaaattacagaattacattgatatggcttagctgtgtccccacccaaatctcgagttgtagctcccataatacccatgtgtcatcggagggacccgggggggaagtaattgaatcatgggagtgagttttttccttgctgttcttgtgatagtgaataagtctaatgagatctgatagtttcataaagggcagtttccctgcacatgctctcttgcctgccaccatgtaagacatgactttgctcctccttcaccttctgccatgattgtaagacttccccagccatgtggaactgtgagtccattaaatctctctttctttataaattaccccatcttgggcatttcttcatagcagtatgaaaatagactaatacatacatctttgagacattttttttctagcctaaatgttaagtggtatatgcataatgagtatggaaagacttcattaattaaacattccatttaagaggactgagcataatattcaaaggaaagaaagaattctaggattcaatcaaactatttaagtactaaagttcacttagagacccagttaatcaatccctcatttgaaagttaaggacattgggagccaggaagtaagtcactaggaactgagagacctgtcaaaaatgacacagctatttagaggcaaaggcaaaaccagaatcagaggtacaaattcctacttcaaaactttttttttcctattagtgaattttaattctcaaaaagtttacttctactcttggtctgaagtgactttttaacctcttaaccttaattccaacatctttgaaaggtgctcatataattgtgactgctgagaggatgttacttcattttgtgaaaaactttgaagataaatagcaccattacaattatgactcatctcaaaaagtttaacatttcaacctttgcttcttattgtctttttatgcaacatgattaatgcactctatttttttgtggctgtcacaagagccacaaaatctctcacttcctttattgtgactcagtttgaaaaaaatatgcacaaactttttcttgagtgcttgcttacataaatttaccaagtaaaaaaattatactactcactcaccatcatcaagtgaaatactatgtcatcttacagcagcatctcctggctgatgtttgtggcaagtctaaagagcttcataaacctttcctacatttcactctgtaggaaaaggtatgggaggtggaagtatgattgtaagataaaagagaattaaggagaaaaaatgatgtggacatggatgagaagcctgggagacaatagaagaggcacaaagagagaaatgaagggagctaataagaataagtgtgtgtatacaggtgtgtgtgttgatgtgtacatgtgtgtttgtgtgcagctggtcacagaaatacagtcagaaagaagtcgttattatgttgttttgactgatctgttgcagaacaggaactgtgatgaaaacagcagcaaacagggtcaacttactattgatcaatataccacaattataataagtagttctaaattaatccaaggctatttcagaaatcccaaatagaacaaaaaaatgaaattctacccttattaatcataccattgccggccaaaaggagcagaattatactcctgagagtattctgaaaatgtcagtgcaacattgttctgtaccaagaactgttagcctgcaaatgtatccttcctttaaaaaaaattgccaccaaaagtagatattaaaggagcaactaaatagatgtttctatttacccaaacaagctccagaggaacttacgtgaagtgtcttaggcagaataaagctatacgttactcagaataaataaataaccaagaatgttatttcttgcacagttcagagtgatagaagggttaaataagtaggtggagataagggaaggcaaagcttaaaggctcacaccttggaagatatttaagtaggaaagcatattgcaaagttcataagattgttctcctagtctattttaccactgtaaaccctctatttaagtatctagctgtatgcatcttccgacatctaaacccaattaaatgccaactgaaatagccttaaattactacccctaagtaattccctcctacttccataaataaaacaaggaaagtaaacagcactaaaaccagctgtgatgtccttcacacacacacacaaaaaaacttctttttaaaagcaaagttttctgagatattaaatttgtaagaggaaaaaatcaacacagactcattcattccccaaatgtgctcacaatttttaaagttttaatattaccatattagtccgttctcatgctgctataaggacatacctgagactgggcaatttataaaggaaagaaattaaattgactcacagtttcacatggctgggaaggcctcaggaaacttacaatcatggcagaaggcaaagcaaacacatccttcttcacatggtgacaggagagagaagtgaaagcaaagcaggggaaaagccccttataaaaccatcaatcttgtaagaagtcacggactggcacaagaacagcatgagggtaactgcccccatgattcaatacctcccaccgggtccctcccaccacacatggggattatggaaactataattcaagatgagacttgtgtggggacacaggggacatagccaaaacatatcaaccactttattcttactcctagttattataaattactgtattttataataaagataatttgtgaaaatgagcttaactgtcatcttttgttttacttttccccagtttcatacacaatatccaggtgccacagaaaaggtaactagtataaaggaatttacaaaattataatttatgaggtttattctgtaccttctgcgccttaaaagaggtgatactattgaaatttggaggtgaaaagattttgactctggaaaaaactgaagccttttagggaaccacttgtggccaaagtctacagtagacttatatagcagaaaatgaattaataatggtatttgaagaggaagaatgaagcaagaggagtgaggggtattggaaaaagaagcaaaaaagtgagacagataaaggaagaatgagagcagcttccaagctctataaaggatcatggaaggaggggggttgggaatctaataggtaactttaaacaagaaaaatggtattaaaaccaaatacctgaaaaactaattgatagtgaccaaaagcagatctgtggttgcctgtggctggggattgagaagggagcttgcctataaaaaggcagacagaaatttctagagtgatagaaatcttatatttcaattatggttgtggttacctgaatggctacatttctcaaaactcaatcaaccattaaaatgggtgcattttattgtattcaaatcatacctcaataaagttgattttaaaaattgaatgtttagtaaagcacactcacagacatatatttaagtgtatagaagaaagagaacaccaaaaaggctgctaaaaagaaacttgcacgaataaataaagcaaggaaagcataaaactatcccataatctttaggaacaatgtgttctagaagagtaaattttattgaatactgaagcttatgtttttaaagcctcccattttttcaattcatttcccctagtatcccaaccccaacattctttctaccacattggatcaccaaatccatcaattatatcaactttttagtcacacacacacacaaacacacacacacgcacacgtaccacctcacctcactacaatcacaccacaccgagctgattttttaaagtgttaagtctgcaaggcttgtgaaaaaatatatacatttaaattactttttttttttttttgagacagagtctcgctctgtcacccaggctggagtgcagtggcacaatctcggctcactgcagcctctgcctccggggttcaagcaattctcctgccttagatttgcaagtagctgggattacaggcacgcaccaccgtgcccagctaatttttgactttttggtagagacggggtatcaccatgttggccaggctggtcttgaactcctgacctcatgatctgcctgccttggcctcccaaagtgctgagattataggcatgagccactgcacctggccttaaattacatttaaaagaaatttggctttaagtgtatcttggctttcagtggaggtcccattcagaaacaaggaacagagaagtgacagtaaagctgagtgatcaccatattgagaaaattctacacagagggaggaaaataagccaacaaaaacaaaatagttcagtgcatcaagggaatcataaatagtcaatctcgctggaaataataagggggagaagaggagactggacatgcacatagcaaagaccagccttagaagtctgaggacgatagccattgattctgtgacaatgaaacctgtgttttgttcattagcatgtccctggaccgtaacaattttctaggatgtactgggtgctcaacaaatatttgacaaatagatggacagatgggtggatatatgaataaataaatgactggcctgaatcatggagggttttgtttgtggtaaaaagtctggactttgatctaaaacccagcttttgctaaccataataatagacaatcatttatgaagtatgtcacaagtaatttgttagaaattaaagtcaaagtaccataatttgtgaataatttactttttaaatttaaattagagtctgttcaagattacccctacattactaccttcatgttcattccttactttactgagtggtaaagtaaggaattttagccaattcaccaataaatgcacatctattataagctgttattgatagtaaattaccacggctaaactactaataactgtggccattataaattattgaagtctgtacttcctaaaaaataaactttaggtaatcctagcactttgggaggccaaggcaggcggatcacgaggtcaggagatcaagaccatcctggctaacacggtgaaatcccgtctctactaaaaataaaaaaaaataaggcatggtggaggggcctgtagtcccagctactcaggaggctgaggcaggagaatggcatgaacccgggaggcggagtttgcagcaagctgagatcgcgccactgcactccagcctgggcgacagagcgagaatccgtctcaaaaaaaaaaaaaataataataataataaaataaactttagcatttctcaaagttgggcaaatcactgaagtatacaaggcatgtgaaatcaccagtcatgtgactctaatgaaggcaacagagagtcattgaataattttaagaataggattgatattatgtaatttgtgctagagaaaaatcacttttgtggcaatgccaattagtggagcgtatgagacctgaggcaggagactgctacaaaagtataggtgagaggtggagaaagtctgaaccaagatagtagcaacaaatatgtagaaaagaaaaggacaagagaagtaaataagcaataaaattaagacttatgcatcaattagattcactaccttaggcaaaatggctttgcttaaacaacaaggtcaaacagcatataaaagaagagggtcatactaggtaggaaagataagaagttctatattagacatgctgacttggatacaaggatgccaaactgagaaaaagaggtctggaatagaggtactgattcaggattcctgaaacagaggtgtaaaagcctagagagagtgcatagagttagcaaaagagaatgtcacacagacagaacctggaataatatcacttttaagataaacagcaagtatttgggcttctactgaaccccaaaaagaagatgcacataatttgaatcatagaccgttagttcctccaagtagagttcctcttagtgtaatttcatgcatagtataggcatttaataattaaaatgaataattagaaagccaaaactaaaaagaaagaaatcatctatactacggctaggaaatcagtttcaagactaactgcagtcattttcgcatgactatctataaaactgtgtcaatagactctgaggtcaagtatggaattcaaaggaaagactcccataactctcaggtaacattaaagccatgggctcaggacaagagaagcaatcattcgtgtgtcacatattgccactattgatattttctgtttattacatagtttattttttattttagtatataatttaactatgaaaataatacaagtaaattgtaatatcaaacaatacagagataaatgcagaaaatataaataatattccccaacctgctctgaagtcttattccccgaaggcaacaaatactcaacaagagtaaaatgttctgcatttatgctctcactcctttctcctgctcataaaagggttttgttttggtttcatttgttcataaaattattatcaaaggaagacattatgacataggaagcattatggcatatggataaaattgctaatgtccaaatttattgttagagttgactatcatttattattgtttaaaaagtattttctataattatatgtaagattatatttttcttctctaagaaggtttatcagtagtttgcctgctacattgatttttatcagcgacccaaatgacttctaagtggcccattccaatgttcaagtttcagtcttcttggcagcatttgacacagctggtcactttgtccttgagatttcaagtagtgttcttaccagcttaatgaagttccttctcagattcccttgctattcctcctcattcttctgacatctaactgctggagtacacacacagtgcccagtcctcagaccttttcttttctccatctgtactatcatccaattccatgtcataattgccatctttattctgtctacctcaagtatgtatcttcagcccaacctctctatcactcagcatcttcattttattgcctaacaggcattcaaaattcatacccaaagtaaactccccatcttttccttaccccaaaatattaccattgatcattaaattgggtgagttggttattcagcaaattgattgacaacttagcagatatttacctccacccctctcattaatctatccactgaagaactgaccataataatatctaaagtatctcagtaacggggagggggaactaagaattttatattcagcaaagttgtcctttaactataaactaaactgataggccatctcaaatatattaagaacttagtaaaattaagcactttgtaagtgcttagtaaaaagcacttacaagtgcttccttaacaaattcccagaccacaaaatctaaccattcaaacaaacaaactcagtaatatcgaaataatagtaatagggctggtgttgagcacaaactctatttttaaatggaacaaggaacatgttattaaatagctttaataactacagttacagaacaaacaaaaaatgtactaaatcaatgtataaagaataagatatcaaaaatcagaggagggggaggggatctgttaaaaagtatgtttgttattttttcatcttttatagaaaatcactagtgattgcactgctttaatatgttaactttgtgctctacaagcctctacataactttcaaacatgctctgttcctatgaccatcactacattagaatagaaaacaattgaaattgactcctaataaatagtcgtacttgaaagaaaaaatatgttaatttcaaactcttagactgagtttattctttttgaatagtgataatgggatttgtaaatcggctatatcatttatggtaatgaaatatttatctgagtggaatcaacagctcctccagttttatttcaatctctctttcttatgttaaattcaagtaaaagtaaattaatacttggtatttaaaatgccatgtatactgtgatcccattttcctaaaattacatctagctatattttgctcaatatagacacactgagaaatgtctggaaagatgttcaaatgctgagaatggttatttctggaaagtggaatttggagtgtttttctgcgttcttatttttctgagttgtttaaattttataataatcacatcattttataacaaaagctattaaattttttgtcaagggccttagtacaaacagaaatattctaatagttaaatctagtaactcccaccaccaccaccatcaacaaaagcaaggccttttgcagttcaaaatacatggaagggatcaaagctcagagggaaagacctcaagatcttgcttttttgggtatgacattgatctcatctcttcaacagtaatagataattttggttttatgtcatctagccatgacagagccattcattgcatcattggttgagataatatagcataaagtatttaacagcaaccaccctaaagatgacaatatggaaatactgcttaatggacagaaatttttttatctgtaaaatagcataagccatgttttacctcctcacattcagaggaggtgattaatgattttcccccttgaaaatataaagtattttttaaatgcctatacttccaaatccatataataattaagtagctctgaacttaacctttcaaaatttattctaaagggtttcttttactttttattctggctttcaaaatagtaaaaggcattattaaattcctttccgtagctgtcacccaaattgtacctttagcacacatataccaccgatctatttgcatctaacatttcatttctttatgcttaaaagcagtaaatgtttcaaaaactgtagatcttcttttcagcataattttcttttgaaagaaaaaattagatagcaattatctgttgatttcataagcagcacatatcatcgggttttgttttgttttgtttttttctttttgtttttttctttttttgcttcttttttaaattttattattattatactttaagttttagggtacatgtgcacaacatgcaggtttgttacatatgtatacatgtgccatactggtgtgctgcacccattaactcttcatttagcattaggtatatctcctaatgctatccctcccccgtccccccaccccacaacagtcccccgtgtgtgatgttccccttcctgtgtccatgtgttctcattgttctttttttttttttgagattgagtctctccctgtcgccaggctgcagtgcagtggcacaatcttggctcactgcaacctccgccttccgggttcaaacgattctcctgcctcagcctcccaagtagctgggactacaggcacccatcaccatgcccggctaattttttgtatttttagtagagacagggtttcaccatgttagccaggatggtgtcgatctcctgacctcctgatccacctgactcggcctcccaaagggctgggattacaggctgagccaccgcgcctggccatcatcgggggttttaaggtcaaacatactactttctggatctgtgttcagtaggtatgctttggccatgtttcacccttttcaactagaccttcttggtgtgactgttgcagagttgccaatgagagaagttaactttaaagtcagctttagtttatttttatagcccttgtgaaaaaccacagttgaatctctttaaaatcaggagacagcttaataaactttttctttgtttgcatataatcataatgggggcaaaagagggatggcttaacaggcaatgaaaaccatttttttttttttacataaggagggatagatgtgaggtgtaaagacatttaattgaattatcagacattctaatatgtaggagaaaatgcctattaggtatttactacttgttttaccccctacttactcaggattaggcaccccagtccccttctattctaaaccaaaagaaataattgaacacattctgcctgaactatcctgaagcagtgtggcatccatttattatcaactacattaataattaggattctcctaatcttgatggaaagattgaaacattaatgttctacattttatcccccattctcccactgaagatcatgtgaccttaagcaagctacctgtcatcacttagggcttagttttccacctgtaaaatgatggaagttaccctagatctgcagttagtggatgttgggggctcacagaatcaaaagaaatgaaaactaatggatctttccccagtaaaatgcacacatgcataaaccaaagaacaaacaatgttctacaaggtcccatatggtatagccagcagtcctctccccaaaccctaattttccaccttcatctccatgttcactctgctccagctacattggcctccttgctctttctcaaacatgacaagcagactatcaacttagggtaattgcattgactgttctcctcacctggaatattcctttttacctccaagcctttgctcaaatgttgccttctcagtgaagcttactctgatcaccttatttaaaattgcagaccacgttgctttccagctttactagcccttgctccttgctgtaaaattattttccccaatgcacttgtcataatctagctgttcacaaaaaacttaacatagcagacctaactgctacccttcaaaaggaaggcttaaaaggttggtccttggctggcatctagaaacttgggtttcaggagggtttccacatgcctagaactggtaagagtagctcactatacctaagtgtttgtgcaaacaatgtagtttatgctgaccatctgctttcctttggccagtatacaaatttggtatgtgctaggcagagggagggtgctgtgtgatcagcccccaataaaaaccctgagcactgagtctccaataaactgtactggtagacaacatttcatatatgttgtcacaactcattgctggaaaattaagtgtatcctgtgtgacttcactaaaagaagtgtgtaacttagtctttcccagactttgcttcttttcccttttctctttgtggatctcgcccaatatctcttcactgtgataaatcatagctgtgagtaaaaccatatacaagtcctgtgagtcctcctagcaagtcatagggaccaggggtaatctccggtaaccccaacccggtagcacactaaaatttactcatgaattatgcctagcacataaaaggtgcttgattaatatttattaaataagtacatgcaaaattttgcaattaatttaagaaagttaatggagctccctaaaaaaagtgctaatcattgatactggtaaggactcctttccaagatgctctccttataatttgaagattcaaaattctaagcaatggccaggtgcagtggctcacacctgtaatcgcaacactttgggaagcctaggcagatggatcacttgaggtcaggagtttaagaccagcctggccaacaaagtaaaactccatctctaatgaaaatacaaaaaatagccaggcatggtggcgggtgcctgtaatcccagctactttggaggctaaggcaggagaatcacttgaacctgggaggtggaggttccagtgagctgagactgctccactgcactccagcctgggtgacaagagcgagactcagtctcaaaaaaaaaaaaaaaaaaaaattctaagcaagaagatctgtctctgaactagtttctcttcctgaaaatgcttacatttatggaaaagtagaaggaactgtatatgttttagttggccaaactaggcacatgtcctcagaattaagtgtgacggcatgttgtaaacttggtaaaaaccctggctacacatgagcccttgatggaaatatgaggtttccatttttcttggataccatagcttcaaaattagatttgggaaagcctcttaaagccagacttttgaagctcagtaatcttctgagccaagttaatctagagggagtctcacggcctcctttaaaaatgaaaaacatggaaagttaaagaaattttaaagaggaaattagaaaaagccaactctgagaacagagccaatctttgagtatgtgcagaacatatgagggaggggagaggaagaaaaagttgttattactgttaactgaatcctgtcagaatcaaaaaacaatgtgcaaagccctctcatgtcagcaatactacaatagagataaccagcagcttgggtgcaagcctacattttaaaatatttaatcttttctggtagcaagaaatattggccaatatatttattttggcaagaaagatgcccacttgtagacaaaatgctcacagaactaaatttcatgctgggtactcaaagggagcatatgagtaggttctgttatgggggcatagtaggagttcaataaatgctagtgaaattaataagcatgcctggtaggtattcaataaatgttagtgaaatgaataaatgtgtgcaagacactgggctacacgttgattatagccttagtgcaaatcatacaggtcttaattactttctatagtaagtctgggcatattacagaatttgggggagattacaaaagcagacccttagtcagtgaattaaaagaagagaattgagattggaaggaaacatttctgctgtttttaattaacaaatcctaaagtagttattttagctgttaaaatagattctaagtctttattcaatttttgcaaattttatcactaaattacttagcaatagcttcttctctaaaccatcctccctcctgctccaccccacacaacgcttttggttccattaaaacctgtaagaatcttgatttctttgcagaaaaagttctttgtggcccaacactaactgcacttaacatatgatcttatcatgatattgttaaaaactgtaaaacctcaaaggtagccaatttcaaagagagaagataagcactaattattcaatcaccaatccccatgtttatagttgcaaagtgcaatcaagaattaatttttaagctagtctcaaagcacctaagagaagatagattaaagatgcagaaagaaacattctaacttctttacacactgaattctatgtatctctagaaggagcctctggaattcccatgtcatcagttctttgatggaagcatttatgtgattctactcttcattcctacttatgacttaaacagcccgtatcttcagtcaggattctgcatgattaagtgccatcctagaccaatgggacgggtctcaacaggcagatcagcggcacccagagggaaagaaatccacatcagatcccaacacagaccataatcttttgaccataccatgtagatttcttattacattcatgagactggtttcagagccctcttcttaccttatcctaaactttctctctagatgatctcaaatgctgccataactttaaatatcatctctaagctgaaactccaaattttaaatctcgagtccacacctctcctcttaaattcaaactcacatatacaacttgatttctgtttttggatgtctcacaggcattgcaaacttgtatgcaaaattgaactgtttcaccctaccacacaccttggatctgcttctcttcaacttcttccatccctataagcagcccctccacctactcatttgctcaggtggaatatttgtgtcatattaatatttatttttcacctccctccatacacaccccacattgaatccatcagccaggcctagtgtgtgcgccacacagatcacaaacctgtcaaaccttttcttatacactgacaaggtcctagtccaagatactgtgtcatttttcacttgggtttcagcatggggagaaaagtccatgcttatacttgaaaaaaaaagaccttttataaaattataacattacaaattttaaacaggcatttaagaagtctcatacgtgtgttcaatggaacacacttgtgtttctttttcttttttatttataacttttattttaagttcagggtacatgtgcaggtttgttatataggtaaacttgtatcatgagggtttgttgtagagattatttcatcacccaggtattaagttcagtacccagtggttatttttccggatcctctccctcctctcaccacccacctttcaataggcccaatgtgtattgttcctttctgtgtgtccatgtgttctcatcatttagctcccacttataagtgagaacatgtggtatttggtttgctgtttctgctttagtttgctaagaataatggcctccagctctatccatgttcctgcataggacatgatcacattttttatagatgcatagtattccatagtgtatatgtaccacattttctttatccagtctaccattcataggcatttaggtttattccatgtctttgctattgtgattagtgctgcaattagcacacaagtgcatgcatctttataatagaataatttatattcctttcagtatatacccagtatttgaattgctggatcaaatgatatttctgtctttaggtctttgagaaatcaccacaccatcttccacaatggtcaaactaatttatcccacaaacagtgtataaacattcctttttctctacaatctcaccaacatctattatatttggactttttaacaatagccattctgactggtgtgagatgatacctcattgtggttttgatttgcatttctttaatgatcagtgattttaagctttttttcatatgattcttggccacatgtatgtcttattttgcaaaatgtctgttcatgtcatttgcccactttttaatggggttgtttttttcttgtaaatttgtttaagctccttataaatgttggatgttagacctttgacagatgcatagtttgctaaaattgcctcccattctttaggttgtctgttgactcttttgatagcttccttttctgtgcagaagctctttaatttaattaggtcccatttgtcaatttttgcttttgttgcaattgcttttggtgtctttgtcattaaatcattgcccatgcctatgtacagaatggtattgactattttctcttcagggtttttatagtttttggttttgcatctaaatctttaatccatcttgagttgatttttgtatacggtgtaaggaaggggtccggtttcaatcttagcatatggctagccagttatctcagcaccacttattgaatagggaatcctttctctattgcttgtttttgtcagctttgttgaagatcagatagttgaggtgtgtggccttatttctgggttctctattctgttccactggtctatgtgtctgttcttgtaccagtaccatgctgttttggttattgcagccttgtagtataatttgaagtcagggagcgtgatgcttccagctttgttctttctgcttaggatggtcttggctatctaggctcttttttggccccataagaattttaaaatagttctgtgaagtgtttcaatggtagtttaatagaaatagcatcaaatctctaaatcactttgggaagtatggccattttaacaacattgattcttcctgtccatgagcatagaatgtttttcgatttgtttgtgtaatctctgatttctttgagcagtgttttatagttttccttgtagagaacttttacctccctggttagctgtattctgtggtgttttattttaccttttttgtgtgtgacacctgtgaatgagattatgttcctgatttgattctcagcttgattgttgttggtacatagaaacattagtaatttttgcacattgattttgcatcctgagactctgttgcaaaactgttgaagtcgcttatcaggttaagaagcttttgggctgagatgatgaagttttctagttataggatgatgtcatctgcaaaaaagggatagtttgacttcctctctttttatttggatgctcttattttctttctcttgcctgattgccctggccaggacttccaatactatgttgaataggattggtgagagaaggcatccttgtcttgtgctggttttcaatgggaaatactagaaatgcttctagcttttgcccatcagtatgatgttgactgaatgagtttgtcatagatggctcttattaatttaaggtatgttccttcaatacctagtttattgagtgtttttaacatgaaggaatgttgaatttatcaaaaagccttttctgcatctattaagataatcatgtggcttttgtttttacttctgttatgtgatgaatcacatttattgatttgcatacattgaaccaaccttgcattctagggataaagcctaatcgattatggtggataatatttttgatgtgctgctggattcagtttaccagtattttgttgaggatttttgcatcaatgttcttcaaggatattagtctgaaattttctcctttttttttttttgtcttgccagattttggtatcaggatgatgctggcctcatagatgaggtagaaagaagaccctccttctcacttttgtttggaatagtttcagcagtaatggtaccagctcttccttgtacatgtggtagaattcagctatgaatccacctggttcttggcttttttgattgataggctatttattacggctcaatttcagaactcattattgatcaattcagagattcagttcttcctggttcagtcttgggaggttgtatgtgtctaggaatttatctgtttcttccagattttctagtttatgtgcttagaggtcttcataatactctctgattgttatttgtatttctgtggggtcaatggtaatgtgtccttgttgtttctgattatgtttatttgaatcttctctctttccttctttattagtctagctagtggtctattttattaattttttcaaagaaatggttcctggattcattgatctttaaatgctttctcgtgtctcaatctccttcagttcagctctgattttggttatttcttatcttctgctagctttgggatttgtttgctcctggttctctagttcttttagttgtggtgttaggttgttaacttgacatctttctaactttttgatgtgggcatttagtgctataaatttcccttttaacactgccttagctgtgtctcaaagattctggtatgttgtatctttgttctcactggtttcaaagaacttcttagtttctaccttaatttcactgtttactcaaaagtcatttaggaggttattcaattcccatgaaattatgtggctttgagtgaatttgttagtcttgatttctcattttattacactatagtccatgacatggtatgttatgatttcagttcttttgcattttgtagagaattgttttacttctgattatgtgatcaattttacaatgtgtgccatgtggtcatgagaagaatgtataatctgttgttttggggtggagagttctgtatatatttagcaggtacatttgatccagagctgagttcaggtcctgaatatctttgttattttctgtcttgatgatctggctaatattgttagtggggtgttaaagtctccccctattatattgtgggaatgtaagattctttgaaggtctctaagaacttagtttatgaatctgggtgctcctgggttgggcacataggtatttaggatcttcttgttgacttgacccctttactattatgtaatgcccttctttgcattttttgatctttgttggctggcttaacatctgttttgtcagacactaggattgcaacccctgcttttatctgttttccatttgcttggtatatttttctctatccctttattttgaatttatgtgtgtctctgcatgtgagatgggtctcttgaagacagcatactatgatttttggttctttatctaacttgccactctgtgccttttaattggggcatttaagccatttacactcaaggttagtaatgatatgtgtggatttgatcctgtcatcatgacgttacctggttgttttgcagacttgtttatgtagttgctttatagtgtcacttgtctgtgtacttcagtatgtttttgtagtggctgacaacagtctttcctttccatatttagtgctacctttaagagttcttgtaaagtagttgatggtaacaatttccctcagcatttgcctgtctgaaaaggatcttatttctccttcatttatgcagcttagtttggccggataagaatttctgggttgaaatttcttttctttaagaatgttgaatattggcccccaatttcctctggcttgtatggtttctgctgaaagctccactgttagtctgatgggcttccctttgtaggtcacctgacctttctctctagctgcctttaacactttttctttcatttcaaccatggagagaatctgattattataggtcttgagaatgatcttcttgtgaagtatcttaggggttctctgcatttcctgaatttgaatgttggcctctttagctaggctggggaagttctggatgatatcctgaaatatattttccaagttggttccattttccccatctctttcagggacaaaaatgagtcacagatttggtctctttacataatcccatatttcttggaggttttgtttgttccttttcattcttttttctctattcttgtctgaatgtcttatttcagacagccagttttcaagctctgggattctttcctccacttgttctattctgctattaatacttgtgattgcactatgaaactcttgtagtgtgtttttcagctctatcaggtcaattagattcttttctaggctggctattttgactgtcagctcctgcatcattttatcatgatttttagcttccttggattgggtttcaaaatacttctgtagctcaatgatctttattcctatccatattctgaattctatttctgtcatttcagccatctcaatccagttcagaacccttgctggagaggtgatgtggtcatttggagcaaagaaggtactctggctttttgagttatcagggttcttgtgctgattccttctcatctttgtggacttaccttccttcaatctttaaaactgctgacctttggatggggtttttttccttttatcctatttgatgaccttgaagtttgattgtggtataaagtgaattcagctaactgccttcatttctggaagattttacagggccaatgcttagctcccaactcctggactgcatgctgtaactctgggggacttgtattgagccccaactttgttctctggctccttgaggttaggaatccacttcactggggaggtgggggagaatgaggtgctcccagaccactggtcagtacactccaacgggtggtgtcagccaaagtgtttcagagtgcgatgacagtgggacccattcttgctcacaagtgccagtagcagcagtagcaacagctgtggcatagtgggtggcaggtgccaggatgcctgcctccctgcaagtgttcaccacagtggcaaagtcaacgcagctggggggcctccgctggtgactgtgtgtgtggtcaccctgaaggtggtgttttggctcaggagtggggcactgatgggtgcaggtctgggtgtataggtctctgtgcctcgcaagcaggaatgattgctcaggcatgggaggatccaccattctctgcagagtgttaccataagggcagagcactggcgggggcagggctggctgactctgtgcccaccaagactctgtctgcaacagaggtcagtggggagaggaagggtagactgcacacccaaatgctgatggtcaagaaaagcaaaacccacctccacagacacatgccagcaaagcaatgtggggagttgccttaggcctaaagaaagctgcagtatgggagggagcatgggggttggtgcatggctgtaggggccatcctgctggagctctctaccagtcaggcacaatctgccagtgcagaagctatggtgtgggaccccagggcacccgaggctgctctgcaagcaggtgtagccaggctggggctctgggaaaggacagcagaccaaggggttctcaggtcagactggcctcgtctgatgggcaagaccaccctgcagagttcaggactgacagttcccctagtcctgcaccaaactcttcgggctccacatcagctggctgctgcccctaacccttctctaagcagctctccatgccatcttgagtgtccatagtggtcaaggggtctccccctgccagggttccagaggcctgtggcaaaagcagtttgctccttgccagtgcaactcacctgttccctcagagccactgggggccaggaatgagtgtgggtatactgtagccccatgtagcgtttccagctttctcacccttcagcccagcttctgcgtcttccctctgtccattcttagtgcctttatctctgaagatgtgttaggagtgtgtcagtcatctgagtcccttcatgagagccgttccacctgcctgcgtctagttggtcatcttgtcccccaccaattctttttctttttttatgattaataggatattataggacttatttggttttgaaactttttcaatataaacatacataaacacatgtactttttcattgtaccataaatgtagcataatattaaatatcagaattctgatttgtaacatccagataaacccataagtgatttttccagtaatcactctttctaattgatttatccattgatcctaccccactgatctaatgtttaatataaaatggcaaatgggctgggtgcaagggctcatgcctataatcctagcattttgggagaccaaggtgggtggaccgcttgagctcaggagttcaagaccagcccggacaacatgggaaaacccatgtgtactaaaaatacaaaaattagctgggcatagtgatgcatgcctgtagtcccagctacttggagtgctgaggcaggaggatcgcttcaacccaggaggtcaaggctgcagtcagctgagatgatgccactgcactttagcctgggtgacaaagtgagaccctgtctcaaaaataaaatcaaataaaagtcaaatggtaataaatagtaacatacttaaagtacatttggtttgctacatggatgtggcaagggagttttaccttgatacttgtaagttgtattctaatatttggatcttcctcattactttaagaaaaaaggaaaaccactcaggccctgttgcccaattattttacatttacagcatgattttgaatgtagaatatacatacatattgtcactgttcttataaagtaactcaaatagatgattctaaatattaaaatgggaagagataaaaaactcaaatcaacaaatatttacggagggcttactatgcacaaatagtgaagctacttacaatccacattgttaagtaggtatgaaatgagcaattagctgcaagttaaagacactcaaaatcacagtgcttcaaatgagacagaagtttactttgctttcacaaaaaaagtctggaggtaaagtgctcctgagctgatgtagtggttctgctttataaaatacctaggaacccaggcgtcttccaacttctcactccgccaccttaggtgtggccttatcctcatagtccaagatgccagctagagttccaaccatgacatccacattccaggcagcaggatagagccaaagtgtgcaggtagactaacttttatggaagtttgcaaaagttacccaataaaaatttcacttatatgtcattaatcttacttgcatctcaaagcataattacagctgcaagggaaactgggaggtatagctgctattactgttggtcattaatttagcaggattctgtttttagaagacaaggacaattcatattggaggcaacatctcactgtcacatctctctcctgcatgtttcccaaaactcaaatttctgaatgttctgtgtctattctgcccagccatgctgtaggaggcagcatgaagcagctcttaaatatttctatatttaaactgcctggatttgaatacagtctccaatgggtcctcatctgtgaaatggagataacagtaagatctactcctaggagctgtaaagattaatcagttcgtacatataaagcgattggcacagtgactgacacactgaaagataagcgcagcatatattactatcattatatcaatttagtcaagaggaaatggaagtaacttaactacaggcttaatagcttcctacacaggatcatgggaggcagtcagaagaacagagttaccactacagttttcatggtgagtcctgctgccaccccagtaccgtccataaagaaaatagagaggaactgacttgtataaagtgtcattttctaaaaaaaaaagctccttattcataccacattaataaagttaggcagaaaatctaaacatacagatcactccccaaaccttcctcagacgatacctgggataaactggtatttcaccctgccaaagagaagtaaaatacggataaaggaaaagcaattacggcaatttgttaaaggcatccagcaccaaagctaagatctgaattcaaaatccctccccactaatcctgtggacaaaatggtggaattcatacttgctgaaaccacctttacttataaatattatgaaaatactttaaaccacaaatcaagcaataaaaatcaggtttagggggaaattttctgggtatttttttcccacacacattcaaaattgcttttaagtctttactgacaaaagtgacattgttttttaaaaataaattgggaatacagaaactgccagattactgtgttggagtagtgttgctgggatatcacctctcttccatatttcccagtcttctaatgttaaatttaggctcctgttggcaaactgtttttcttcttttatggcacaaaatgattatcttacttcaactgccaaagtccaagcttgagacatgcaggataaagaaaagtgaataaactgctgtgtttccattttccaacatcacttgcaggcagcaggaagtcacaagcataaagtcacagggaattatcacaaagacaaaacaattcatttaaggctatttagaagcatatttttttatttttgctcccaaatgttgtctagtcatagtattgtgagaatcaacaaaggattctcctccaactgggggagggccgggggagggacagaatgggctagttcagatttggaacagtgacctagaaggcagttctatcactcagctattcaagtgatgtggccatctgaacatctttcccttccttggtagcagagtgagatgaatatatatgtgttaacattcttgagatgagatatagtatctttcctagccaaacataacttctccaaagccaactttttccacatgctttagagtaagaaagataatatttttagagatgttgagaacttttaggctttatcactaaaactgaattcacccagtgaagaggaaccctaaggaaaatttcaaacataatgtcttcccagtgaatttcatctttactcctgaatctgaggcaataggctactttctcccttattaaacataaagaaaaataattacttaatgagagaatatatagccattctcaataaaagcaactgggattccacaaacattactatgtcatgactgaatgaatgaagtgctaagataaagagtttagaaagaatgaaaaacctaattacttataggaatctgtgtgattaagtctagaaaaataaaaggaagaaaagtgcattagtctaatgagatgtagacaaaatatttaaaattggctcaaagtgtttggttgaattatcttgaataataaaagattaaatttcctagaaaatctttgttccaaagtaaaatgattttctgattcatgcttttgaaactttataaagtgaaacaaaagggcattttcctattctttttagtgttgaaaaatggtaactgggcctcagcagaactgaatttgggaacctaaatggcaaacctaaaaattcacttaaagaaggtgaattaggaaactttgttcctcataacagagctccagtgcttgagaactaaagcataaaactactttctgtgaactgtagagatagatttctgtaagatgtctgactcctccattaggaactagtgatccacatttttaaataagcaggaggttcatggatacagatcccattttttgagaaatgttgacctaaacaacacttacctgttctgttgatgcagaatgaaatcaggtaaactgccctaagcttcctcaagatctactcaagctcagtttatcctgttagcctatatctatctctttttctttacacattttttaaaagcaattttccctaatttcatatcccatgatttggagtcgattgtccactctcaataagaaggtatttctcctacagctctaactctggaactgttttatgaaagcttgcaaacagttagtaagcattacactcacctctgaaagatttttcctacctgtaatttaatttagctccaagctatagcacgtgaatgcccctgcattctttatatgactctttacgtcaagtctctacacactggattatatgaagatcccctatgattcacacagtcaataaataaatcaacaaaaatgtagaaaggaaggaggaggatccagttttagatagtaaagatcagaaagaatagtctacatactttatcaaagcgtactgcaatgaaaagtgtaagcatgactactttcaaatgcagattcctagcatgttcatttcctttgttcttcaagtattcatggaattaaagaaacaggaaacaatcagttatgtatattagtgcttccttcactgcactaggtcatcataagcttctgatgaccaaacagaactaagactaaaatggctgatgttcctaaaaacctcccagttgacccagataataagctaggatcaaaaataacaacaagccaatgcagcttttttctctaagaaattctgttattgctgttattagatttacagttacattgggatgctaagatttcttgctgtatttttatggtaattgcagttttatatacataatatcatcaacagctcatatattctgtgggctggttttatgctgggttggatttaaatgctcttcaaggaactgtacttttttgtccccatttaaaaagactgtagacaggtcagataataatagcaataactcagaaacctgaagattagaaaattgaataaggctgattctaaaaaggcatggaaatttcatacccatgctattttgttggctcactgagtacatgatggagtaaaaagaacattgaaactaaaatctgggaacatcagctctaatttcagctatcacactgtcctttaaggtcactggcctccttgggcctcagttgcctcatgtgaaaaatgagaggtctactagattatacatggcacttactttcatctctcacatcaattacaatcaactgataatggctggctgaagcactgtgttaagaaggattatgaggctgattctggacaaaagtagagtgtcatgggtgatttgctaagtcttccataaggacattgaggaaatagctgtacatatgcaatatattttccttatttgacccaaaggaccactaggatttcctttagttacagtctataaagcatattttacaataaaatatcataagatcctttatacaaaatgtttggtcttgttgcttcctccagccacccaagctgctgaaaggaaagaaggccaaggcagagaaggtggttctagtcccttatcataaagaagcagaaggccaacaaggtggtgaatcccctgtttgagaaaaggtctaagaattttggcattggacagcacatccatctcaaaaggaacctcacttgttttgtcaaagggccccactgcatctggctgcatcagcaaaaagctatcctctatgaatggctgaaagtgcctcctgcaattaaccagttcatctaggctttggactgccaaacagctactcaaatgctgaaactgacccacaagtacagagcagagacaaagcaagagaagaagaaagctgctggcaaagaagatgttcccactaagataacacctgtcctttgagcaagggttaacactgtcaccaccttggtagaaaacaagaaggctcagatggtagtgactgcacgtgatgtgggttccatcaagctgattgctgagggctcgccctgtatcctaagatgggagttccttactgcactatcaagagaaggcaagcctaaaagacatccagtccccaggaatacttgtgccactgtggccttcacacatgttaactcagaagacaaaggagttctggctgagctggtggaagctatcagtactaactacaaggttagatataatgagatctgtcagcactgaggaggcaacatcctgggtccaaaatctgtggcttgcattgccaagctagaaaaggcaaagactaaagaacttgccactaacctgggttaatgtacactgttgagttttctgtgcacaaaaacaatccaaattctttaaaaaacagcttggttgtatagattatctataaaatgatttctatattgaaaatcacttaacttcatgacactgtttcctcaatagtatacacacacacacacacatatacacacacacattgatgagaaaaaaaaatctactgccagccagagccactgtcagtatggggtttccacattctccccatctgtttgagttttctcgtgggacaccagtttcctcccgtatcccaaagatgtccacattagattaattattgtatctacaatgtccaagttggagtgagtgtgggagtgtgtgtatgagtgaggctgcaatggaatggagtcctgtcaagggctggttcctgccttgcaccctgacctgccaggataggcaccagccacccacaaccctgaacaggaataagcaggttggaaaatgaatgaatataaattattgtaaaataaatttattttgacaccaaacagtggggtccaaaagtgctcagcaagcctgccatatttattgtttgtttttgaactgtgtggtgataggaggtgctccttataattctcactttgcaaacatttattccttgattcaacccatcaccactacaaccactatcactcactgattcaccaaaacttgggtaaataattatcttacttgtttttattaatctttcttgaatgtatgtttggctcacatttatttcaatgtttaatattaaaagtgttttgagtctttacttagaagtttgatatttctatgacaaacatgctgtaggagcttactgcttgtttatgtaaattagcctaaggtaaagttagttttattacatatcattttgcttaaagttgtagtctccaagaacctatcgacaacgttgagaacttactgtgtgtaaatgtgtgtatataaccttgttttattgtgcctcactttatggcacctcacaaatagtgtttttttttttttttacaaattgaaggtttgtggcaaatcggtgtcaactgctatttttccaacaccatgtgctcacttcctgtctctgtgtcacattttggtaatttccacaatatttcaaacttcttcattattattatatctgttacaatgatctgtgatctatgttaccatcgtaattgttgtggggcaccatgaacagcacccataaaagaaagtgaacttaattactcaatgttttatgtgttctggctgctccaataaccagttgtccccatctcctccatctctccttctcctagggcttttttattccttgagatacaatgttgaaattaggccaattaataatcctaaaatgactctaagtgttcaaatgaaagaaactgtagcaggtctgtcactttccaccaaaagctaaacatttccttaagccaaaacctaacccagagcaagacctacctcttttcaattctatgaaggctcagagaagtaaggaagcttcagaagaaaagttggaagctcgcagaggttggtttataagatttagggaaagaagtttccttcataacataaaagttcaaggtgaagcagcaggtgctgagggagaagctgcagcatattatccaggagattagcccagataattgatgaaagtggctacactaaacaacagattttcagtgtagacaaaacacccttttagtagaagaagattccatctaggactttcagagctagagaggaaaagtcaatgcttggtttcaaagcttcaaaagacaggtggactctcttgctggggctaatgcagctgatgactcttaaagtcatcaacttaattgaagccaatgttcatttaccatctgaaaatcctagggcccttaagaactgtgataaatctactctgcctgtgctttataaatgtaacaaagcctagatgacagcacatttgtttatggcatggtatactgaatattttaagctcactgtggagacctactgctcagaaaaaagattcctttcaaaatattacagttctttgacaatgcacctggtcacccaagagctctgatagagatatacaaggaaataaatggatttttcatgcttgctaacacaacatccattctgtagcccatggatcaaggagtaaattcaactttcaagccttattatttaataaatacatttcataggctatacctgtcatagatagtaattcctatgatggacctgagcaaagtaaattaaaaaccttctagaaagaattcaccattctagatgccattaagagcattcacgattcatgggaggaggtcaaaatcagcattaacaggagtttggaagaagtcaattccaacctgcttgaaaaactgtgagggcttcaagacttcaatggcagaagtaacagtaaatgtaagagaaatagcaagagaactggaattagaagtgaagcctgaagatatgggtaattgctgcaatctcatgataaaacttgaatggaggagtagttgcttctactgggtgtgccaagaaagtagtttcttgagatggaatctactcctggtgaagatgcagtgaacactgtttaaatgacaacaaaggatttggaatattacataaacttagttgataaagcagtagccgggtttgaaaggattgaccacaattttgaaagaagttatattatgggtaaaatgctatcaaacaacatcacatgctatagagaaatttttcattaaagtaacagccaattaataggtctaacttcattgtggccttatttttaagaaattgccacagccacccaacatacggcaactattaccctgatcaatcaacagccatcaacattgaggtaagacccttcactagcagaaagatcatgatccactgaaggctcaaatgatcattagcatttagcaataaagtatttttaaattaacatatgcacagtgtttttggatataatgcaattgcacacttaatgggctacagtatagtataaacataacttttatatgcactgggaaatcaaaaaatttgagcgacactttattgcaatatttgctttattgcagtagtctgaaataaaacacacaatatctccaaggtatgcctctatatataaagagagggagacctaggaaaatacttgaaatgtattaattaatttgtttcatcttcaggagccagattgtgttaggctattcttgtactgctgtaaagaaatacccaaggctgggtaatttataaagaaaacaggtttaattggttcacagttctgcagactgtacaggaaacatggagctggcatttgcttcttgtgagggcttcagtgagcttacagtcatggcagaaggaaagggaagctggcttgtcacatggtgacagcatgagcaaggtgtggggggaggtgccatatacttttaaacaatcagatctcatatgaactcaaagcaagaactccctcatcactaaggggagtacaccaagccatttatgagggaccgagggacctgcccccatgatccaaacacctcccaccaggccacagtttcaacactgggaattacatttcaacatgaaatgtggaggggacaaacatccacaccatatcagagaccaattcttctctttattatacaaatgccaataaagcccaggagagaaaataacagaaaaaaaaattgtagctaatggcaatcactgataaggaatcataaatgagactcagaatatcttaaaatagttgtgcaaatgacaggaaaatcaaaacaaccttcttccagtaaatgtctcatgaagcaattgtgtataagcaaactgcagtagcttgcctacaatagctaacaacatcatctcacttaagatggatgaggtaaaagacatttctgccaatcttgctgtagccaccaaaaagcaaaaaatatgtaacagtcttttcgatgtcaacatttctttgatgatatctgtaaacatttgtttccatgtaacaagcaacctattcttcaaccaatgaatacagcatgagataagagtcataagacttgaagtttgctcccctctttcatggaatcattggggtcttcataacccacctaacctcagctgcctcaataaattatgaaagttgaccaatatttctcttctagctcataagaaaatgaattgaagtcttgtagaatggagaagtggctgagttgcaaaaatccttggagaggctctagaccaggtactggttgtcacctttacatggccatggtgggcttcttgcaatcactcattcttcaggataaattctatccctgagcaaagaaagcaaaatcttgtccttattaagactatatttttattgtcttttttttccaaagtggacataaatcctagcttacctattagtaatgcacacataatcacatcaagtttgggcaaagctaatgacttatccaatatcacatggtggttcaataaagaaattaaatatcacaattcccagatcttgttccaactaaataatggcaatactgaagcaaaattaggatatacacgatatatcctaaggattataggcaaactcaaaagcctacaatgtttagttgttggagttagagtgacaatcagaaatgttaatgtttatccaactccggtattccataaaatatcccagtttcatgtcaaataagttatacctacaatactttttactacggagaactagaaaaatctaaaatgaaaagagaactaaatacaacatgttctgatatattatgctctaggcaatgatcatgttcctaatttacaaagtccatgaaaagaatactcttatgttgaaatagctgttattaaaagtgagtgctcttacagtgaaaatagatcagatgtaacatatctctaagaaattattgttgttctagccattactttgtgaagatgtgctttgttttgattgatttagaaaattgtaataaataagaactgttcagttggaatatgatgtttattccttatgccaatatacgaccaaaaatattttctcacttcagcctagaaagtgagatgtgtattatttatctccaaataaatgtgtaaaaagatgtgtgctttcagtttttcttctttatcccaaaatatttaaatgcctaataaaataatattgttcattaatatattaattgtcctgcttatattttcagtatccaattagtcatttcaagtatgagatatagaaaagaatgcttggaatgtttgctatggctttgtacaaataaaatataatacctaacaagggcaggaggaaggaggagggatttataagtttgcttattgtatttttaaaagtcaaatttcatttaaaattatgtttaaataatattaccagaatattccaaaataaaagtcaaaggtaagaaaaataatgttaaaatcttctcaaatttatgaagaaaaaatgaagtaaaaaataaaaaatcttgtgaaatttatctggtctttcctgaagctctttggtatctccatagacatggtttgaatgcaaaaaactgcccatgcagtgtctatgataagattgcctttaacacactcagcatgctaatatatcaggttcaaaaaatgatttcataattgttttacttaagactaacaggcaaagattgtcctgaatttgctgctctgctgtgtttttgtaggaccaaatcccaggtgcagtttggcctctaagaggcataatctgctccaggaaagccaatcaggaagtcttccttttaactatggcacaaccgttcagattcacctgctactgctgtttccccagaacttctactctaattgaatgtatcaagttgttaagcaattttacataagatgtggcttaaaataagtagctttttatatagaatgaaatgttctgatgaatatagtattacactttgaaaaggaagaaaaacatctagtggatattgtcatgtttgatatttctttttggtgtcaatggaaactgaatagtacatttttttcaacttttactacatattaaagggatggaggaagtagaagcgtaaacagagtaaacagggatggcaagacaaaggagtgttaagtcctcgaggattttacaatctagttattgaaataagacatataggtttttatttattttttcaatttttaatttttgtgggtacatagtaggtataaatatttatagggtacataaggcattttgatacaggcatggaaagcataataatcacatcatggaggatggggtatcaattgtctcaagcatttatcctttgtgttacaatcaaattacacttttagttatttcagaatgtataattaaattattattgactatagtcactctgttgtgctgtcaaatagtaggtcttattcattctttctactttttttttgtacccatttaccatttccatctctgcgtcacctccccacaactacacttcccagcctctggtaaccacattctactctccatctacatgagttcaattgttttgatttttagatcccacaaataagtgagaacatgcaatgtttgtctttctgtgccttgcttatttcacttaacttaatgatctccagttccatccatgtggttccaaatgacaggatcttattcttttttatggccaaatactactccattgtgtatatgtaccacattttctttatccattcatctgttgatggacacttaagttgcttccaaattttgtctattgtgaacagtattgcaacaaacatgggagtccagatatctcttcaatatattgatttcctttctttggggcatatacctagcaatgggattgctgcatcatttggtagctctatttttagtttttgagaaacctcaaaactgttctctataatggttgtactaatttataatcccaccaagagtgtacaatgactcccttttctccatatcctcattagcatttgttattgcctgtcttttgggtataagccattttaactacggtgagatgatgtataattatagtcttgctttgcatttttctgatgagcaatgatatttagcaccttccatatgcctttttgccatttatgtgtcttttttttgcctcaaactccatctattctacatagctattccagttttcttttgattcgtagtttcccagtatatattttttattcttttaatttatttatttttcttctttttttttttttttttttttagacagagtctcactctgtcgcccaggctggagtgcaaaggcgcggtctcggctcacggcaagctccgcctcccgggttcatgccattctcctgcctcagcctcccgaatagctgggactacaggcgcccaccaccatgcccggctaattttttgtatttttagtagagacagggtttcaccgtgttaagccaggatggtctcaatctcctgaccttgtgatccacccacctcggcctcccaaagtgctgggattacaggcgtgagccaccgcacccggcctgttggttgtatctttagctgagtgaatgatttgcaacttgacgtgatcccatttgtcctgttttgttttaggtgcctgtgcttgtggggtgttactcaaggaatctttgcccactccaatgtcctggagattttctccaacgttttctgtagtagtttcatagtttgagatcttagatttaaatattcaatccattttgatttgatttttgtatatggaagagataggggtctagtttcattcttctgtacatggatatccagttttcccagcagcatttattgaagagactgtcttttttcgccaatgtatgttcttggcacctttgtcgaaaatgagttcactgcaggtgtgtgaattagtttctggattctttattctgttccattggcctgtgtgtctgtttttatgccagtaccatgcagtattggttactatagctctgtagtaaatttgaagttaggtaatataatttctccagttttgttttgttttgtttttttctttttttggatggctttggctgttctggctctttcgtggttccacataattttccttttcttttgagtctgactcttgctctatcacccaggctagagtacagtggcacgatcttggctcactgcaacctctgcctcccacgttcaagcaattcttgtgcctcaggcttctgagtagctgggattacaggtgcaccaccatacccagctaatttttgtatttttagtagagacagtgtttcaccatgttggccaggctggtctcgaactcctgacctcaagtgatctgcccgccttggcctcccaaagtgctgggattacaggtgtgaggcaccgcgcccagcccatataaattttaggatagtttttttctatttctgtgaagaatgtcattggtgttttaatagggattgcattaaatatatagattactttaggttgtatggacattttaacaatattgactttttccaatccatgaacatggaatatctttccattttttggtgtcttcttctatttctttcatgagtgttttatagtttccattataaagatctttcacttctttggttaagttaatttctaggtatttaattttatttgtggctattgtaaatgggattccattttaatattttttcatattgttcactgttggcatatagaaatgctactgatttttgtatgttgattttgcatcctacagctttactgaatttgtttatcagttctaacagttttttggcagaatatttagatttttccaaatataagatgatataatctgcaaacaagcataatttcacttcttcctttccaattggatgctctttattttttctcttgtctgattgctctatctaggacttccagtactatgttgaataacagtggtggaagtgagcatctttgtgtgttccagatcttagtggaaaggctttcaattttttctccattctatatgacagatccccagctagtataacactacagcttttattatattatatattttatattttattatattatattaattatactttattttattatagtataatactatagcttttattatgttgaagtatgctcattctatacccaggttttttagggtttttatcatgaaaggatgttaaattttatgaaatgctttttcagcatcaatttcaattgaaatgaatgtatgatttttgtccttcattctgttgatatgatatatcacattgattgtttcatgtatgttgaaccatccttgcatcccagggataaaatccacttgttcatgatgaatgacctttttaattaattgttgaatttggtttgctagtattttgttgaggatttttgcatcaatattcatcagagatattggcctgtagttttctttctctttttttttctgatgtgtctttgtctggtttttgacatcagggtaccactggcctcaaagagagagtttggaatttttccctcctcctctattttttggaatatttttactagcattggtattagttcttctttaaatgtttactaggattcagcagtaaagccactgggtctgggcttttctttactaggagacttttactacagcttcaatcttgtcacttggtattgatctgttcaggttttttatttcttcatggttcaatcttgataggttgtatgtgtctacgaatttttccatttcttctagattgtttcaccttattagcttatagttgctcatagtagccactaatgatcctttgaatttctgtggtatcagttgtatgtccccctttttcatatgtgattttatttatttggatcttctctcctttttcttactctgcctaaaggtttgtcaattttgtttagctttttaaaacaccaactttttgtttcattgatcttttatattgttttcatttcaatttcatttatttctgctctaatctttatttatagtttcttctactaatgtggggtttgcattttctctcacttttccagttctttaaaattcctcattatgttatttatttgaagtttttttttcttttttgatatagacatttatagatataaacttccctcctggtactgattttactgcattccacaggttttggtatgttgtgtttccattatcatttgtttcaaaaaatttttcaatttccttcttaatttcttcattgacccagtggtcattctagagcaggttgtttaatttccttttatttgtatagtttccaaaattcctcctgttattggtttgtagttttatttcttgtggtcagagaagatgcttgatatttcaattcttttgaatgttttaagacttgttttgtgacctaacacatggtctatccttgagaataatccacgtgctgaaggaaagaatgtgtattcattggatgacatgttctgtaaatatctactagatccatttggttcatagtgcagattaagtccaatgtttctttgttgattttctgtctggtagatctgttcaatgctgaaagtggggtgttgaagtctccagctattattaggggcctctctctttagctctaataatatttgctttatatatctgggcgcttcagtgttgggtgcatatatatttaaaattgttatatcctcttgctggattgatgcctttatcattatatagtgactttctttgtctcttcttattgttttcgccttgaaatctattttgtctgatataaatgtatctacttctgctcttttttagtttccatttgcatggaatatcttttcccatccctttatttttagtctatctgtgtctttataggtgaagtgtgttttttgtaaggcacagatcaatgggtcttatttttttatccattcagccactcaatgtctttcgattggagagtttagtccatttacattcaatgttattattgttaaaaaaggacttactcctgccattttgttgtttgttttctagttgttttgtggtcttctcttccttctttcttcccttcatgtctccctttgaatgaaggtgttttctctggtaatgtttagtttcttgttttttttattttctgattgtatccattgtatatttttggtttgaggcttccatgaggcttgcaaatactatcttataacctattattttagcctgataactacttaagttgtttgtagaaagaaagaaacaaacaaaaagaaaactaataaaaactctatactttgttccctcactttttaacttttttgtttctatttataccttattgtactatctaggtctttaaaagctttgtagttattatttttattggctcatcctgtagtctttccacttaagagtagtttatgcaccacaattacagtgttataatattatgtgtatttctgtgtacttactattatcaatgagttttgtaccttcaggtgatttcttattgctcattaatatacttttctttctaattgaagtactctcttttccatttcttgcaggacaggtctggtgttggtgaaatccctcagcttttgtttgtctgggaatgtttttatttctctttcatctttgacggatgttttcaccagatatactattctagagtaaaagtttttttttccttaagtgctttaaattaaattaatgaataaatggaccttattagaacagacgaggcttggaccttaaagggcacactgtatatggacaagtagaaaatatggagagagaaacttctagttataagtgagtttctgcaggccttcctaatctcgtggcgatagatgagagttcattaatagaaataatccaaatttcttccctcaactatctaatgtcaggtctccttcctgaagaatttctgtgaagccttaaagagtgtcaagatcattccctcatgaacttacatttagaaaccctttcccactgatatcaatgccacatcattgtccctcctgcttgtgccctcagcttgagacagcagatgtgatactcaaagagctgcctgcctccaagggaccacagaggcattctatttcctgcagtcctccctgagtcagaatcactctaatgagttaaaattatgagaatttttttattattggaggaagttattttatctaattcttgatctacttataataagtaatcctagaatttttttttttttttgagacagggtctcattctgtctcccaggctagagatctcagctcactgcaacttctgcttcccaggctcaagcgattctctagcctcagcctcccaagtagctgggactatgggcatgagccaccaatgcccagctaatttgggttttgttttgttttgttttttgtagagatggggtttcaccatgttgcccaggctggtctggaactcctgagctcaaagccattttcccacctcagcctcccaaagtgctgggattacaggcatgagacactgtacccagccagtaatcccagaatttttacaaaagctcctattgttgcataatgaaacagtattctcttgccattatttaaagtcacttttttcactttctggtaaaaaaattcgttcaatcattgacaaatatttgctgaacacccactctgtgccgtgtactactatgttaggtgctggatatatgttgatgaatgaaacaaactgtatccttgtagaatttgagtctgctgaactcagaagtaaattctttgaaagttaggatggatagtaaagttgagtactcttagtttcaatatttaacatgttgctcttatcaattttttagtaaatgttagtgtacaaaggtaatttaggttttgaggtgtatccagaaaaatctggtttttttaatcaagagaatccactcaagagactactcatagaaaagaatttatatgatgcatcagatagaaagtaaaatttagtgttttcctgaaaaaaaaaaaaaaaacacaaaaaccaaatacaatggaggcttctcttccacattctgtggcatttgttttttcaactaaacaccaacactacactcatgaaaacaactccttcagcactacctgtactctgcttcaccaaaccagaaacgtcaatataaaaaacaagcagcatgccaaaggtcaactgatcttcaacaagggtgccaaaaatacacaatggggaaaggatagtctcttcaacaaatggtgtaaaaactcatatccatatgcaaaaacatgaaattgaacccttacaccatacataacattcaactcaaagtagattaaagacaaacataagacctgaaactataaaacttctagaagaaaacatagtggaaaatcttcatgaccttggtcttggcagtgatttcatgaatatctcatcaaaaacacaagcaacaaaagcaaaaataaacaaatgagcccacatcaaaggagaaagcttctgcacagcaaaggaaacaattgacagggtgaaaacgcaacctacagaataggaaaaaatgtttacaaaccatatgtattagtccattctgcattgccataaaggaatacctgagacagggtaatttataaagaaaagaggcttattttggcccactgttctgcaggctgtacacaaagcgtggcaccagcatctgctcccagtgagggcctcaagaagcttccaacaatggtggaagggaaagggggagcctgcgtttcacatgataagagagagagcaagagacagagggaggaggtgcccggcacttttaaacaaccagatcgcacatgaattcacagaatgagaacccacttgttactgcaaggacagcaccaagattttcataagggatctttccccatgacccaaacacctcccattaggctcacctccaacattggaggtcacatttcaacgtgagatttggaggggacaaaacatccaaaccatatcaccatatatctgataaggagataattcctaaaatatataaggaactcccacaactcaacagcaaaaagactaataacccaattttttaaatggggcaaaaaaacttgaacagactatgtcacagtatctatgtgaaaatatacgcaacatcattaatcatcaaggaaatacaaatcacaaccacaatgagatatcatctcacacctgttagaatggctattatcaaaaagatgaaagataagtgttgtcaaggatatggagaaactggaacctttgcacactgtcagtggaaatgcaaaatggtatggccgctatggaaaacaacatgaagtttttttaaaaattaaaaatagaactaccatatgattcagcagtcccactctgggtatttatccaaaagaactgagatcaggacttcaaagagcaattagcattcccaggttcattgcagcactatctacaatagctaaaatgtggaaacaatctaaatgtccatcaacaaatgaatgaataaagaaaatgttgtatctatatacaatggaatattattcagcctttaaaaagaaggaaattctgcaatatatgacaccagagatgactgaggaaattgtgctaagtgaaaaaagccagtcatcaaaggacaaatactgcatgattccacctatatgaagtatcgaaaatagttaaattcatagactcaaagaatggaatggtgattgccagggactcaagggagaagaaaaagggaagttgataatcaaggggagtaaagtttcaattaatcaagataaataagttctagagatctgctgtacaacattgtacctatagttatcaatactatattgcacacttaaaaaatttgttgaaagtagatctcatattaaatgttttacaacaataaaataacataaaaaataaaatgacaaagaagcatgctgtaatggctattccaggttatcttccagtaggctttgctaattgatttcctccaacctcagcctagagctcccaggcaaagcaactccttatgacctacacagttgttcaacactcatactcagacatggattaatcacacttaagtgggaacccctacacaggaggattaaggtaaggtatcagggcactcagtatatcagcttaattatgtcagaagatttgtgatgatgaactgtgacagacaaggctagtcaaataagatgagtcctgttgcagatggtaatttaattaccaatttcgggcatgtattgagccctgaccacttgtgcaaaatgttttatttaggtcttatcatgacctatttgaaaatgacaaactgaggtttagctatattaatctgtcaaggtcactcagctagcgtgtggcagagctgagaataaaaccatgcctagtgaatgtcagagtctctgcccttaactactagaccataccatggttgtgagagaatcagtaaagggtcatgaacaaatgttggtatgaagaaagcaccattatagaaagactggattgctggggacaatgtataggagagaaagatagttggaggaggggaaacttgttgctttcatttaatgttaattagtaaaagttcagtcctaatccacaataatatttatactttctcatagcactagtgtgtttccttaataaatggactaaagcagtagcttggaataccagcactaaacttaagtttttaagattataaccataaagatctgtgtgaatgatgaccaaatggttagtaaaaaaaaaaaaaaaaaattatgtaataaaaaacccaccaccaacaacaaagaaaattacccaaagatgactgagaaacatctttacaccactatttgcctaatagaatgactaaataaaacaaacaatgccagatgctggtgaggatgtaaagcaactggagctctcataggttgctgatgagaatagaaaatggcatagccctgtgaaaaacagttttccagtttcttataaagttaaacatatatttagcatattacccaaaaatcctacttctaggtatttacccaagtgaaaacctctattcatacaaaaaaaaaaatctgtatgtgaaaaaagtatgtgtatatatatatatatatatatgcattattcataattaccaaaagctgtaaataacctgcattcccctcaaatagacatgtgtttttaaaaatggtgatacgcccatagtgtgaaatagtatccaacaataaagataaataaactattgatacatgcaacaaagggatgaatctcaaatgctttatgctaagtgaaagaagtcagactcaaaaggctatagtatgattccactcattcatataacattctggaataggcaaaacagatgagtgggtgtcaggtgttaaaggtatggggaagatttgacttcaaagggagaagataagagaatattagaggaggtatattgaaattgttctttatcttaactgtggtaatgggttacataactctacctattttccaaaactcatagaaatatacaccaaaaaagtcaattttactgtatatgaattaaaactacactttcaaataaaaaatctcttctacaagaaagcatacagcaaaagtttcacatattctaaatgttataaaccacgaaacatttcacaaagcaccatctacaaaaaagataatgtaactgagtatttaaacaaaaaaccaagctataattttttaaaaattatatacaaggcataaaacatgcctattaaaagcataagtagttggccagcgtgttgtttaccacctctgaatagctgtaaaatgtttatagatttttatacctttcatgaataaagcagagtaaattaatgcaaagttatttttctgagagaagctgtcaaactcctttctggccaaaagggaatttgtgacttcctgttatgttaaatttggtactaaagcctgaatgaaccacctcaaatgggctatttactatgataaatactgtttcctaacaagaggaaaagtggtggcctgggaagataactgctgggattttaatgcactctctgaaacactctgacatactctgttagagaaaataatttaatattaaccagaagtcaggcttaacattccatttcctgaaaatgatcatcaaaagacaaatgcaatttaattcaccaaacatgtattaagcatttaatatatgccaagcactgtgctaggcattaggtaaacaaactgaaaataacacaatatttgcctttaaagattgcacaaactagcaggggatagagacaagtaataagcaaatatacttccatacaataatctaagtgtgatgatagaagtgtgatcgggtacggggacaaccaggggaaaaagtgattgtctgagttctaacaaaaagcacatcaaccagatcctaggactccctaaatctgccttcagatgattaaaatgctaacaggaacaaatagaaagctgcatgatttgaagaggccattccttttatatttaccaccaccatcttccatgacagttttgaaaacactgagcaaggcatacctgtgctgatgtatttattccttgacttgaaataatcctccaggtgatgaaattcccacaggacaaaggaataataatctaaagtctccctttccagaaagtggaaaagttccaagtagtattattccttactgaaacctaagatccctttatgcaaaagaataaaaaaaaaaggtctcatgcctcatgctaattcactgtggctaactacactacttaaaattaagatagaaaggtatgaatgttccatttttcctgtatgttagcagtgatcatatctaacacataattccaattcactgttactacgaaatgtaactattgctccagtactctcacaacggattaaacaagtaaaagtaagcattccgaaataatggaactcctactatctcctgtgtcttcaagcccttccctgaaactactagccctaacagagaagaacccagtagcactttctttcctctcttctttctatcctttccattctatccgtcacagaaagtagcatcttttttccttcatcctttttattctatccatcacagatattaattccaggtatgtacacaatggccaactagcagaaaataaatcattagaaaatgttaaaagcaaaacagtgggaaggaaaacctaagtgtcacatctttgagggccagcactacgtttccaaaatgggaaaggttttatagctagaagatctgggctcagatcctgcttccgccacttactagctctgtagctttagacaacatattcacctgtctgaatgtcagtgttcacttccacaaaatgtagatgataggaactgctactttgcataattattcttgagattaggtgccatacaagactgattctcaatcccactgcatgctaaaattcgggggcaccactctgagactctgttttcattggtctactgtggggcatgaactacaaaaagagagagagaagaagcagcacatctccaaggtattcaactttacagctgggcaacaacctctgcattatagtaactgcaagaactccctaaactttaattcagtgcagcatttcacaatttattattgtattttaaaagtaccattgaactcatcctgttatgcacgttacatagtcttaaagattgctagtaattcaatagttaaatttgatgtttacttagaatgcctcccttgacaagcaaatcatcattttcaacaactgagaattgttacaaggagctgagaaaacaagatatatacattaaatgattaaagtcacttcttaggtgccaaaaatgaaaggagtatgatgatgggataagctttatgatgcttgaggtcaggtaccatgatttttaaaaatagtttcagcatcaaggacagtgcacagaactcaataaatatttgttaaataagtagatgaatgtgtgagtgaacggatgaatgtaaagatttccacaggaatttaccaagagtcatcactaaagactggaatgaagaggaaggtattttcattggaaaaataagtctcagccactgccaccaatgaagctgcaatgtctctaatgaagagaccgaacttcaggtttgaaaggtaaattgcagtccttgcattttcagttaaatctttcaaacagcagcccactccgcctccattcttggtcccaattctgactctcctccaaacttctaacattaacaattggcacaaggctagctttctaaaacaaacatttctcattactaggaacattacaaaagtcttgctttctgagcattggatacctgctttaagagctagttaatgcacagtataaaacaaggaagacaaaagacatgatctacccagctgggttagccaaggggcctgggagataaattgaccaactgcctgtgtagcatcttacattctccaaaataaccctacaaggttgctgcagatctcagattaagaaaaatttattgctgagtttattatttttaacatcctttgtctgagcacctagcaactaaagtgataagtaccttcaacttgcaaggataaatgctgcaaatatcttggctgaattacccatttgtatgtatgtttgtaacttgaattattcatttacattttttattttttaaagaggagaataaaactagaaagagaagagatactaaaaaatctcattgctgtagatttaaaggttttccggtggtaggaagccaaaaggccccttcagcaataaacaatagatttattctacaatctaattaatactcacaaactatgttacttatgaaacaaacaatatatctagggaatgcaattgcatccaagcaaaagtatccatattaataaggaaaaatcttacaaaagtaggcttggaaaagtatgtgcagcaaaaaagttatggtttttctttaaaactgtatttgaatactaacaacaatgggtaggtcccatttaattgctggtcttacaataaagcaaacattttaaatttgggtgacgatatgagctttccctgaaaactttgctaataacaacctagggtatctatttcttatttgaaaaggaatgaagggtttcctacacctatgtgtaggtgataatgcaagaccatgaaaattctagacccataaacctaccatagaaaaaaatttaatcccttccaaattaatactttgctattgtccaaatgatagtttaagattaacattgatttatttatttgttttcttattaacaataacaccaccactttgtcaatggttgtcaaagtggggtatgtcattgtgatgtgagaagaaaatatcagaacttctacttgtacttatttttatcaaaaacagaaagaaattaaactttattgatattttaaaaagaaattacactgaccccattccctgtccctatatcaaatgtaaacaagacaggcagatttcatgagataggcagaaggaagtagttgttggtgaaacactcactcatctcctagctttcatcaggttgcaaagtaccatactgtgtgtagccacgagtagtggatttactgaatacattacctagttttatttaaactaaccctacaaaacaaaaaagaaagaaaaaaattcttgcaaagaatcatggaatttatgattacacaaataattgatgattgataataattggtggctatacaaataatgtaagcacaaaaaaaaaggtggagctgtaacttctgctcctgcggtgagttcttcatcattcctgagtaaatcagcctgacaagaagtcaagcaaaaaaaaaaaccttttcataatattaaaatatgaacattcatccaccatcattaaaagtcaaggtagctttaagtatatagaatgccttgagatattatgcaatgataatacaaagctatcatcgttttcaaaccgtttaaaaatgttgattacttcacctttatcccattcttccctttatatattgcactgtgtacaatctgtattaggtcagtagtacatatgcataattcatagtgaagagggaatcccagaccttattctccaagtcacactgcccttctcccagcctccacaccatcatctacaggagttagagagtatcaaagttctatatctgtctccacaacactcatagccttacaactttaaagaccatcaagagaaattccatcaacctctttatcaccacaggaaacccaaagttcctgggttttccctcactactaggtctctggtctatgcatccttaatttcaccctgtcttcccaagttcagagcccattacactatgtcctctggagaacataaagtccctcatgttctatctcctcctgaatactgcctccacctctttgctgtaaataaaagccagttattccccaaggactctcttcccctgtagggtccacaaatgatggctattttctctctcatattccaactatcactgtcctacttcctcatcattgtagaaaactgtgtcccttctacctccctccaaaaatccagccttgcaactcatgccatcaaattagacaacttttactactactggctgcagttaacttcagtttctataactgctacaagattttgattatgattttatcatttgcatctgtcatttccacataactgaatctcccagtaccctcaatcctcagatccttaaattgtaaacttcaatgagcttgtcctcagccatttcatggtgatctggacctcttttttattatcaataacagcagccctccatgacctcaactccaagtatccagttccaaaatattacttcccatttttccagctcacgccctctcattctttgataacaatccttaatcaactttttgctgtattttacctccttctgttctagttacattgcctccttacttagcttagattccatggtccatcattacaatcagctccctggtggccctctcttcccttgtttaatcaacctggtaaaacttatactttgactaaatacagctttccacccacttgaacccaaatatctaaacatgggctgagaggattacacaccatccttactggtttcactttaaattcataatgataatcttcaatggggcttcagttcctcccagtgatcttttatgcatttctgcagtcaattcattctcctacacaaccgtttaacgtctctttcctcaaacctccaacattttctctaccatcctcactataatagatgaaacatattcacagatatacaccaccatatctagcagcctagcattcatacacccactagtgtaaactatccaagctcttatctaagaaaacctctccacatgtatcctaacttttaactctcctcactgtctgaaatgcattactctcttcctcttctctctcattgtatcaacactattttctcaattgtggatcatttaatttacatcaaacatgatgttatatctcccagaagataaaatatatctggaaaacccaagagaatcaactgaaaaaaatactataaacaatatgagaatttactacaatatcatgatgcatattaatacagagaaagcacaaggcttcatatattcaataaaatatgccatttacgatagcagaaaagacactagagtaaacttaatagaaagtatgtaagatctataggaagaaaacctaacaacacaactgaaaacacaaaagaagacttcagaaaatgaaattacatcagctagaaaaacacaacatcataaatatgtcaattcttcttaagataatttataaatataaaaccatcataataaaaatacaacagttggtttgggggacttttgatgttattcttttatttttgaacaaagtagctgaccccaaagttcttataaatagtaagcatgcaagaatagcaagggaagctattacaaagaacaataaaggggtgagggtatgagcaccaccatacattaaatgagaaaaaaagaagagccaaaacaatgctaaaaaattaattttaaaagtccaagaacttgaactgtctgacttcagaattcaacataaagcctcagtaatcaccgcaacacatttttgggttgaatatagacatataaattaatggagcaaaatacagagtccagaaataaacctggatatatatgaataattaattttcaacaaaagagcaaagcaatttgatgagaaaaggataatattttcaataagccatgctggaagaatgactaaccatatgcaaaaaaaaatctccacacttacctcatgatacacaaaaattaattcaaaatgggtcacagacctgttaaattttagagttaatactttaactcctagaagaaaacatagaagaaaatcttagtgatgttgggtctggcaaagatattttaagcagggcacgaaactataaaagaaaactgaactggacttcatcaacactaaaacattttgcttctcaaaagacactattacaaaaatgaaaaggggatcttggaccagatggccaactagacacagccaggaaacatctgtctcaccaaggaaaaaacaaaatatggggtaaaccatcacactttgcacagatcttttgagagaaaacattaaaagttgacaaaaaagaaccacagacacccagtttgaagaaggaggaagctaggaagcctacatagagtccctgagtgccagaacaagctcctagtcctgcaaaggccctaaagaaggggtgagttaaggaattctggggacctcaggagtcctagctacaaggataccctgcccaggtatcttctacacttgacctactacatcaacagaccacccatagacataccccacaacccattctgactcttgccaggcacagaggaccagtgggtcgtcagagagttgtaagtctccttacaactgaccttcagctcaggcttcccccaaaagagaaggaggtgcagcccaccagggacccccttggggctaaggaaatgcaggcactgcaacagtgattaaagaggtctcccccaaggccccagaatggatttggtaagggggtcatcacttgcacccaccccctcgtcttctcctccccagaacactgctgtgaacagaatgaaatataagagacatgcatggctgagcaagatcctatctgctagcccttactcttaagcaccatctaatagaatgcagcctagatgacaccacgaaaacataaataaattccataaatatgcatcacctgtgaaacccaatgcagcaaaactaatcacaacgaaggaacccatacagagccttggttctctgaaagcacctagaaaaaggaccaattgactatatacagtcaaaccctcaagtgaaaaaagtacaaaaacaaaaaggcccattcaaatgacataactttaaaaaaaaaaaaaaagaaagaaacaaagaaacactagccctctcaggtgagaagaaatcagtacaatgactctggtaattaaaaaagtcagagtgtttccttaccttcaaaagatcacactacctacccagcaatacaccctaactagattaaaatgtggaaatgacagacatagaattcagaatctggatgggtaggaagctcgatgagattcaagaaaaagttgaaagccaatccaaggaagcaagtaaaacgatctaagagttgaaagatgacatagtcattttaagaaagaaccaaactgaacttatagaattgaaaattttactgcagaaatttcaaaatacagttggaagcttcaataacagactagaccaacctgaggaaagaatttcagagcttagtcagacaaaaataaagaaaaaaattttttgatgaaccttttaaagcctcaaagaaatatgggattatgtagagaccaaatctatgactcattggctttcttgagagaggagagtaagaaactttgaaacatatttgagtacctagtccaggaaaatttcccaagtctcactagagaagtcaacatgcaatcccaagaaactcagagaaccctcatgaaatgctaaacaagaagatcattctgaaggcattttgtaatcagacttttctaagtcaacaaagaaggaaaaatcaaaaaggtagctagaaaaaagggtcagattacttcaaaaggcaaccccagcaggctaacagcagacttctcagtaggtttctacttttcaagcaagaaaaaattgggagcctatttttggcatccctaaagaaatgaaattccaatcaagaatttcaaaccccaccaaactaagcttcatagtacaggagaaataaaatcttttctggacaagcaaacactaagggaatttattaccactagcccggctataaatgagatctttaagggagccctaaacataaaaaagaaagaacaacacctgctaccataaaaacatatgtaagtacagagcccacagaccctataaagaaacaatgcaattgagaatacaaagctacaagctaataatatcatgactggatcaaaacctcacatatcaatattaatcttgaatgtaaatgatatagatgccccatctaaaaggcatagagagcaagcaggaaaaaaaaaaaaaaaaaacaagaaccaaatgtcttctctcttcaagagaccaatcacacataacagccataggggcaaagtaaagggatggagaagcatctatgtattagtcagttttcacattgctataaagaatacctgagactgggtaatttataaataaaagaggtttaattgacttacagttctacagactatacgggaagcatagcagcttctgcttctggggaggtctcagggagcttccaatcatggtggaaggcaaagagggagcaggcatcttatatggcaggagcaagagcagagagggggaggtgctacatacttttaaacaatcgatctcatgataactcactcactattgcaaagacagtaccaagggaatggtactaaaccattcatgagaaatccacccccatgatccagtctccactcaccaggccacacctccaacactgaggattacaattcgacatgagatttggataggaacacatatccaaactatatcagtctatcacataaatggaaaacaaaaaagagcagtgattgatattctttcataagataaaacagactttaaaccatctacagtaaaaaaaaaaaagaacaaagaagggtattacataatgataaagtgttcaattcaacaagaagacttaactatctaaaatatctctgcacccaacatcagagcacccagattcagaacacaactgcctatagacctacaaaaagacttagatagtcacataatagaggaggacttcaacacaccactgacagcattagacagatcactgaggcagaactctaacaaagaaattatggacttatatttgacacttgaccaactggatctaataaacatctacagaatactccactcatcaaccacagaatatacattcttctcatctgcacacagaacatactgcaagactgatcacatgctcagccataaagcaagtctcaaataactttaaagaatgaaacataccaaccatactcttggaccacaatgcaataaaaacaaatcaataccaattaaacatcccaaaaccacacaattacattaaaattagacaacttgttcctggaagacttttgggtaaacagcaaaatcaaggcaaaaaatagaaaattatttgaaattaatgaaaacagagatacaacataccaaaatctgtgggatgcagcaaaagcagcattaagaggaaagtttagagtgcaatatgcctacatcaaaaagtcagaaagatctcaaattaacaatctaacattgcaactatgggaactagaaaaaacaagaagaaactaattcaaagctaacagaaaatataaatatctaaaatcagagcaaaactgaatggaattgaaaagtgaaaatccacaaaaagcagcaacaaaaccaaaagttggtctttgaaacaataaacaagatccatacactgctagtcagaaacaaagaaaaaaggaagaagatccaataaacacaataaaaaaatgacaatggtgacattataaccaatttcatagaaatacaaaagatcctcagaaactattatgaacactatctatgcatacaaactagaaaatctagaggaaatgaatacattcctggaaacacacaacttcccaagattgaaacaggaagaaattaaaactctgacctgatcaataacaagttccaaagttgaatcaataataaaaattctaccaaccaataaaagccctgaaccagatggatttacagctgaattctaccagggatacaaaaaagagctgctaccaatcctgctgaaactgctcgaaaaaacagaggaggagaaacttctccctaactcattgttcaaagccagcaacatcatcataataccaaaacctgacaaagacaggatgaaaaaagaaaactacaggccaacatccctaatgaacatggatgcaaaaatccccagcaaaatactagcaaaccgaattcagcagcacatcaaaaagttatttcaccatgatcaagtgagcttcactccaataatgcaacagtgattcaatatatgcaaatcaataaatgtgatttaccatataaacagaattaaaaacaaaaccatatatcatcttaatagatgcaaaagaagattttgccaaaatccaaaatcccttcatgttaaaaaacctaacgagcatatctcaaaataataatagccatctatgacaaacccacagccaacatcatactgaatgagcaaaagctggaagcattcccccttaagaactggaacaagaaaaagatgcccactctcactactcattttcaacacagtactggaagttctagctagaacattcaggcaagaaaaagaaataaaaggcattcaaatagaaaaaaaaaaaaatcaaactctctctcttcagagatgatatgattctatacttagaaaaccctgaagtctctgccaaaaggtttctagaacagataaacaacttcagcaaagtttcagaatacaaaatcaacgtattaaaatcaataacatttctatacaccaataacactcaagctgacatccaaatcaagaacacaatcctatttattaatacaatatccacacacaaaaataaaagacctaagaattcatctaaccaaggaggtaaaagatctctacaaggagatctacaaaacactgtttcaaagaaaccagagatgacacaaaataaaaataaaaataattccctgcttattgacagaaagaatcaatatcactaaaatggccatattgcccaaagcaatctacacattcaatgctattcctatcaaactaccaccgtttttcacagaattagaaaaaaaatttctgaaactcatataaaaccaaaaaagagcccaaatagccaaagcaatcctaagcaaaaagaacaaaaccagaggcatcacactacataaattcaaactatactacaaggctacagtaaacaaacaacatagtaccagtataaaaatagacaaattcaaaagctagcagaaggcaagaaataactaagatcagagcagaactgaaaaagaaagagacacacacacacacaaaaaaactcttcaaaaaatcaatgaatccaggagctggttttttcaaaaagatcaacaaaatagatagactgctagcaagactaataaagaagaaaagagagaagaacaaatagatgcaataaaaataatataataataaagggaatatcaccaccaatcccacagaaatagaaactaccatcagagaataccataaacacttctacgcaaataaactagaaaatctagaaaaaatggataaattcctggacacatacactctcccaagactaaaccaggaagaagttgaatctctgactacaccaataacaggttctgaaattgaggcaataattaatagcctaccaatcaagaacagtccaggaccagacatattcacagccaaactcttccagaggtacaaagaagagttggtaccattccttctgaaacaatttccaaccaatagaaaaaagagggaatcctcccaaactcattttatgaggcagcatcatcctgataccaaagcctggcagagacacaacaaaagaagagaattttaggccaatatgcctgatgaacatcaatgcaaaagtcctcaataaaatactgacaaacccaatccagcagcacatcaaaaagcttatccaccatgatcaagtcggcttcatctctgggatgcaaggctggttcaacatatgcaaatcaataaacgtaatccatcacataaacagtaccaatgacaaaaaccacatgattatctcaatagatgcagaaaaggccttcaacaaaattcaacagccttttatgtcaaaaactctcaataaactaggtattgatggaatgtatctcataataagagctatttatgacaaacccacagccaatatcatactgaatggcaaaaactggaagcattccctttgaaaattggcacaagacaaggatgccctctctcaccactcctattcaatgtagtgttggaagtcctggccagggcaattaggcaggagaaagaaataaagggtattcaattaggatacttcagcaaagtctcaggatacaaaaccaatgtacaaaaatcacaagcattcctatacaccaatagcagacaaacagagagccaaatcatgagtgaactcccattcacaattactacaaagagaataaaatctaggaatccaacttaaaagtgatgtgaaggccctcttcaaggagaactacaaaccactgcccaacaaaataaaagaggacacaagcaaatggaaaaacattccatgctcatggataggaagaatcaaaatcatgaaaatggccatactgcccaaggtaatttatacattcaatgccatacccatcaagctaccactgactttcttcatagaattggaaaaacctactttaaaattcatatggaaccaaaaaagagcccacatagccaagacaatcctaagcaaaaagaacaaagttggaggcatcacactacctgacatcaaactatactacaaggctacagtaaccaaaacagcatggtactggtaccaaaacagaagcatagaccaatgcaacagaacagaggcctcagaaataataccacacatctacaactatctaatctttgacaaacctgacaaaaacaagaaatggggaaaggatttcctatttaataaatggtgctgggaaaactggcgaaccatatgtagaaagctgaaacaggatcccttccttatatcttatacaaaaaataactcaagatggagcacagacttaaatgtaagacctaacaccataaaaaccctagaagaaaacctaggcaataccattcaggacataggcatgggcaaagccttcatgactaaaacaccaaaagcaatgacaacaaaagccaaaatagacaaatgggatctaattaaactaaagagcttctgcacagcaaaagaaaataccatcagagtgaacaggcaacccacataaagggagaaacattttgcaatctacccatgtgacaaagggctaatatccagaatctaaaaagaacttaaacaaatttacaagaaaaaaacaaacaaccccatcaaaaagtgggcaaaggatatgaacagacttttctcaaaagaagacatttatgcagccaacagacacatgaaaaaatgctcatcatcactggtcatcagagaaatgcaaatcaaaactatgatgagataccatctcacgccagttagaatggcaatcattaaaaagtcaggaaacaacagatgctggagaggatgtgaagaaataggaacgcttttacactgttgatgggagtgtaaattagttcaactattgtggaagacagtgtggcaattcctcaaggacctagaactagaaataccatttgacccagccatcccattactgggtatatacccaaaggattataaatcatgctactataaagatgcatgcgcacgtatgtttattgcggcactattcacaatagcaaagacttggacccaacccaaatgtccaacaatgatagactggattaagaaaatgtggcacatatacaccatggaatactaagttcatgtcctttgcagggacatggatgaagctggaaaccatcattctaagtcaactatcacaaggacagaaaaccaaacacttcatgttctcactcatagatgggtgttgaacaatgagaacacatggacacaaggcagggaacatcacacacaccagggcctgtcgggggttggggggctgagggaaggacagcattaggagaaatgcctaatgtaaatgacaagttgatgggtgcagcaaaccaacatggcacatgtatacctatgtaacaaatctgcatcttgtgcacatgtatcctagaacttaaagtataaaaaataaaataaaataaagaaaagaaattcactgacattcagaaaaaaaaatagacacatagtcacctgaggtcaggagttcgaggccagcctggccaacatggtgaaaccccgtctctactaaaaatacaaaaatcagccaggagtggtggcacatgcctccaatcccagctacttgggagggtgaggcaggagaattgcttgaacctgggaggcggaggttgcagtgagcaggaatcctgccactgcactccagcctgggtgacaagagcaaaacttcgtccaaaggaaaaaaaaaaagacacatagattaatgggacagaatagagaacagaaataaggccacacacctacaaccatctgctctttgacaaagttgatgaaaacatacaatggggaaagaactctctactccctattcaataaatgatgctgagataactggctatccatatgcagaagaataaaactggacccctacctctaactacatacaaacattaactcaagatggattaaactatcctctaaaactgtgagaaataaatttgttgtttaggttaaaaattttcaaaaagtttaaaaaaaaaggtggattgcagacttaaatgcaaaacctaaaactaaaaatattctagaagaaaagctaggaaatgcctttttagacatcagccttggaaaagaatttatggctaagtcctgcaattgcaacaaaaatgaaaaagtgggacctaattaaactaaagtgcttctgcaaagcaaaagaaactatcaacagaataaaaagacaacctacagagttggtgataatattcacaaactaggtatccaacaatggtctaaaatccagactctataaggaacttagaaaattcaacaagcgaaaaacaaataaccccattaaaaagtggacaaagaacattaacagacatttctcaaaagaagacatacaagtggccaccaaacatacgaaaaaaatattcaacatcattaatcaaaactatgagatcccatcttacacaagtcagaatgtctattaataaaaagtcaaaaaaaaaacagatgttggtgaaggctacagagaaaagtaaatgcctataaactgtttgtgggaatgtcaattagtttagccactgtgaaacacagtttggagatttatcaaagtactaaaaatagaattaccatgcgaacagcaatcccaatactagggatatatccaaaggacaattattcattcaaccaaaaagacacacacacccagatcttcatcacagcactattcacaatagcaaagacatggaatcaacctaggtgcccgtcaaaagtgaactggataaagaaaatgtcgaatacagtatgcccataaaaaataacgaagtcttgttttttgcaccaatatggctgcagctggaagccaatatcctaagtgaactaatgcagaaacagaaaaccacatactgtatgttcttgcttataagtgggagctaaacattggatgcacatgggcataaaaatggtgacaacaagagtgcggaaaaagggagaaaggaaagtgttgaaaaactaatcattgggtactatgctcagtatgtgggtgataggtttaattgtatcccaaatctcagcatcacacaacacacccttgtaaaaaacctgcgcatgtaccccttgaatctaaaacagaagctggtgggaaaagggcttacagagctccaaaaaaaatgaatgaaaaagtacaccacggaatgggagaaaatattcgaaaaataaatgtcccacaaaggacttatacctagaatatttaaagaagttttacaacttgatagaaggacaaacaaaagattgaacctaacaggcatctcaccaaagaagatgtagagatggcaaataagcacgtgagatgtttaacatcattagttattaaggaaatagaagttaaaaccaaattgagatagttctacatgctcactagaatggctgaaatttaaaaggctgaccataaaaagactattggcaaggatgtggaccactgaaactctcatacacagatagtgggaatgtaaaatggcacaactcctttggaaaacagtttgatgatttcttaaaagtgtaaaaatacatctaccatgtgactaagccactgcactcctagatatttgctcaagataaatcaaaatgtctctttacacaaaaacttaaatacatgaatgttcatgacagttgtactcgtaatagcctaaaactggaaacaacccaagcatctatcagcagctaaataaataaacgaataatggtatccatacaatggaatactatttcacaatatttaaaactactgataaacacaacatgatggatgaatctcaaaataattatgctgagtgaaaaaaagctacataaaaagagcacatgttatataattccatgtctataaaattccagaaatgtgaattaatctacagtgacataaagcagatcagtggttacctgtggagaggaggaagagagacacaggaggcagaaaagggaaacattgcagacgggcaagagaaaactttagggagagattggtacatttactatcttgactatggtgatggtttcaccatcgacatatttcaaaactcatcaaattgtacacttaaaatgtatgcactctactttaggggctgaagcagggggatcttttgagcctaaaagctagaaggtagcctgggcaacacagcaaaaccctgtcactaaaatatgtatgtataatgcattacatatattaaacctcaataaatctatttttaaagccttggtaattaaaatactgatgctgtaagatgaataggaagaattaaaaatccaaaaatagattcaaatacataaacgaatgcattctgtgaaaaaagtgatatctcaaacaagttaggagacttgctggtcaagacttgctcttggaaaaactggataaacatccagaaaaaattaaataagattgaatccatacctcacattatatcattatattccagatgcatatattctaaatagatcaaagatttgcttgtagaaagtgcaaccatgtgataattccttttcaaccttgggcctgcgagctaactatgactgagtcaataaaagaaaaaaatgtataaatctgacaacaattaaaatcttctccatggcgaaaatacaccataagcaaattcaaaagacaacaatctggaaaaagtgtaattgcaagtcatattacaaagagttaatctactcaatattttaaaagctcctaaaaatcagtaagcaaaagaagtccagtaactcaaaagaaaatgggtaaagaatgtgaacaaatatgcatatgtacagataaagatgcttaacctttctaataaaaaatgcaaattaaaataacactagataatatcttttgcctatcagcttagaaaaataaccaaagttaaagacactgttagttaggcttcagcatgcaggtattctcatacaccatgagaatgtaaattagtaccaccattttggaggacactttggcaatatctgtacaaattacaaatgcatatgccctttaaccccaaactttcacttctgagaatttatcctacaaataacacttgcatgcctatgaagttgtatatatgcatgtgtaggtgtgtctacatacttaagtgtatgtatgtatatatgtatgtatgtgtgtatatatatagttattacttacattattctgtgtaatggcaaaagattgaaaatcattaaaatgtccatcaataaaggactggtcaaacaaattttggtatgtctatataattgaatactataaagctgttacaaaaaataaggcagatctctatatgctgatgtggaaagatctccacttgatttttttttattcaggtttcatcattttacttttttcacaaaatttgtgtatgtgactcacatcaattcattttgatatataatttatttctgatattttgtttatttgaagtgacaggtaactgggtaattatctatactctgcttttaccatgtattttatttctaggtaaatttgaaaaatctgaagtatttttctaaatttgatcatggtttatttgacagtttacaagtacttgcaggcatgtgtttgcatgcgaataacgacaaatagctaagaaatcttacaatagtatagtttcataatttgggggtcctggttatacattttacatctgtaggttaggaatgcatattgttaatttcccttcatggttccttataactaaactctgtttagtaagattttctacttatcaaaggcataataactcactatttggtatatttgctctttaatgtgacatatgacatattttctgtggataaggagaactctgtatttgtgtgtatatgtacatataatgttttcaactaatcactatttcagagaaaaaacagatgaaaagaaacttgtttgcattacattaaatataatcctatacatgttaagaggaagttttttttgtttttttttttttttgagacagagtctcgctctgtcgcccaggctggagtgcagtggcgggatctcggctcactgcaagctgcgcctcccgggttcacgccattctcctgcctcagcctcccaagtagctgggactacaggcgcccgccgctacgcccggctaattttttgtatttttagtagagacggggtttcaccgttttagcctggatggtctcgatctcctgacctcttgatccgcccgcctcggcctcccaaagtgctgggattacaggcgtgagccaccgcgcccggccaagaggaagttttacagcaagaaattgttcctttttttcttcccatttttctttttatatatacatattttttttctattatactttaagttctagggtacatgtgcataatgtgcaggtttgttacatatgtatacatgtgccatgttggtgtgctgcacccattaactcgtcatttacattaggtatatctcctaatgctatccctcccccctccccccatcccacaacaggccccagtgtgtgatgttccccttcctgtgtccatgtgttctcattgttcaattcccaccaatgagtgagaacatgtggtgtttggttttttgtccttgcaatagtttgctgagaatgatagtttccagcatcatcgatgtccctgcaaaggacatgaactcatctttcttatggtgtcatagtattccatggtgtatatgtgccacattttcttaatccagtctatcattgatggacatctgggttggttccaagtctttgctattgtgaatagtgctgcaataaacatatgtgtgcatgtgtctttatagcagcatgatttataatcctttgggtatatacccagtaatgggatggctgggtcaaatggtatttctagttctagatccctgaagaatcaccacactgtcttccacaatggttcaactagtttacagtctgacctacagtataaaagtgttcctatttctccacatcctctccagcacctgctgtttcctgactttttaatgattgccattctaactggtgtgagatggtatctcattgtggttttgatttgcatttgtctgatggccagtgatgatgagcattttttcatctgtctgttggctgcataaatgtcttcttttgagaagtgtctgttcatatctttcgcccacttgctgatgggttgttttttttttcttgtaaatttgtttgagttctttgtagattctggatattagccctttgtcagatgagtagattgcaaaaattttctcccattctgtaggttgcctattcactctgatggtattttcttttgctgtgcagaagctcttgagtttaattagatcccatttgtcaattttggcttttgttgccattgcttttggtgttttagacatgaagtccttgcccatgcctatgtcctgaatggtaatgcctaggttttcttctggggtttttatggttttaggtctaacatttaagtctttaatccatattgaattatgaaatgaagcgtgaagagaagtttagagaaaaaagaataaaaagaaacgaataaagcctccaagaaatatgggactatgtgaaaagaccaaatctacgtctgattggtgtacctgaaagtgatagggagaatggaaccaagttggaaaacactctgcaggatattatccaggagaacttccccaacctagcaaggcaggccaacattcaaattcaggatatacagagaacaccacaaagatactcctcgagaagagcaactccaagacacataattgtcagattcaccaaagttgaaatgaaggaaaaaatgttaagggcagccagagagaaaggtcgggttacccacaaagggaagcccatcagactaacagcagatctctcggcagaaactctacaagccagaagagactgggggccaatattcaacattcttaaagaaaagaattttcaacccagaatttcatatccagccaaactaagcttcataagtgaaggagaaataaaatactttatagacaagcaaatgctgagagattttgtcaccaccaggcctgccctaaaagacctcctgaaggaagtactaaacatggaaaggaacaaccggtaccagccactgcaaaaacatgccaaattgtaaagaccatcgaggctaggaagaaactgcatcaactaacgtgcaaaatcaccagctaacataataatgacaggatgattcacacataacaatattaaccttaaatgtaaatgggctaaatgctccaattaaaagacacagactggcaaattggataaagagtcaagacccatcagagtgctgtattcaggaaacccatctcacatgcagagacatgcatagctcaaaataaagggatggaggaagatctaccaagcaaatggaaaacaaaaaaaaggcagggattgcaatcttagtctctgataaaacagactttaaatcaataaagatcaaaagagacaaagaaggccattacataattgtagagggataaattcaacaagaagagctaactatcctaaatatatatgcacccaatacaggagcacccagattcataaagcaagtccttggagacgtacaaagagacttagactcccacacaacaataatgggagactttaacacccaactgtcaacattagacagatccatgagacagaaagttaacaaagatatccaggaattgaactcagctctgcaccaagatctccacttgttaagtgaaaaagatctcccacaatgttaagtgaaaaaaagcaagctacagaggagttgtatagttgttacttttctgtaaaatgatggggtaataagaatctatatttatgttttcttatatatataaagagtctctggaaagatacataagaaacacataattttgattaccctgatggatgggtggggttgtatagatgagggcagagaagtcaagggaaacttcactgtacatttcatatataatttttctgatctgtttatatatctgtctctcccctgaaaacaacatgctatgccccatggggtcaggcacttagttgtaatgtttaatgtaatgtttatgtttatctccagtgcctcaaatggttcctagcaaatggtagaacttttgtaaaacttattttttgatagaagtgcacattttaaaaactttcagaccactgtagtaaattatgtctagatttccttacagctctagagtaggtttcagcaaaatttttctataaagagccagatactaaatattttaaggtttgttggccatatggtctctgtcacgattactcaactctgcttttatggtacaaaagcagccacagacaataagtaaacaagtgggtgtgactgtgttctaataaaatattatttataacaacaggtagccagccagatttggtccaagggctgtagtttgcccaactctgttctggaattttgtttctctgattatccatcagttgaaccttgaaaggtatgtaagatttccatctttcaaaataaaaaaattggataacgaatgaacgaataaataaataaataaatattaaccaacttttccataaggaagagttattcatattcttattcatccgatcttattcatcagatttacttcttttatattgggctatatgatactgtatctctaatgagacttttttgctttaaatccactgcattttattttattaatttataatttttattggtacatattaggtgtatatatttatggagtacatgagatattttgttacaggtaaataatgtctagtgaggtgacttttgaacagggacttgaaggaagtaaagcagcaatctatatggttagctaagggaagagggcctcagggagaagaaacagtcaacataagctacttgaagagaaaatttgcttggcttgtcttaaaactatttttaataatttcattaaagcaaaaaattctacattatagaacaccaaatatacaacttatttagtttaatatacaaatatatatctcttaagaacacaactccaaaatgaaaatatttagatattaagttaggacataaatagactaatcatttaatgatacaactccaggaggcacatagccctaagacatgtttgacaccgacatactaaaagttgaagatgctatttattatcctgcccaaattatttaaattattttagtgtatgcttggtcttgccatgattgtgagaagagcacagagacatcagaggatctagtttcttatcctaactctaccactaactagccatgtgacaagtttttaatggtaaacacaggagttgaactagataatgcctactcttcctatataacattcagcaatatctggataaattattgggtatcacaatgagtcaaggtcagggatgctcttaaaaacctgcaatgggccgggtgcagtggctcatgcctgtaatcccaggactttgggaagccgaggtggacagatcacctgaggtcaggagttcacaaccagcctagccaacatggcgaaaccctgtctctgctaaaaatacaaaaaaattagcctagctgggcgtgatggcatgttactgtaatcccagctactcgggaagctgaggcaagagaatcgcttcaactcgggaggcagaagttgcagtgagccaagagcactccaccctgggcaatagagcaagactctgtctcaaaaaaaaaacaaaaacctgcaatgcagaggacatctcacacaataattattcaacactaaatgtcaatagtgccaaggttaagaaaccctgtcctaatgaaaaggattcttctctacttcattgaaggtggtcaatgactatcatatattaattaggaatccttctggctaacaaaacctgaaataaatggtagtttaattttctgaaaacaaattcataagggtggctgccaacaacagaacagcttcaagaactcataggctaacccccaaagtgatgatattagaaggtgggaccttttgggaggtgattagttcaggaaggcggaacccttatgaataggatcagtgctcttataaaagaggccaaaaggaacccatttaccttctaccttgagagaacagagcaggaaggcactgtctatgagaaagtgggccctcaccagctgccaaatataccagtgccttgatcttaaacttcccaaactccagaactgtgaaaaataaactccagttgtttataagctacctagtttgtggcattttgttacagcagaccaaatggactaagacagggagaaagcagtagtactagccacatctatgtcttttatcaggaaagcaaaatctaacaccttaggggacagaactaccttcaagggaggtcaggaaagtcacttaaccctcactgcctgcaagggaggctggactagtaaacacttagcttccttagacttcatagtggagtctggcaaaagagaagaggattggaaattggtcttaggttaatcagttaatagagcctaccttatagtcaatatcctctcacatgaattaagatgaatactaaataataaataagtcctcatcaaacagttgatttctgggatttcctccttggtagagatgaaagaataggtgcgtaaggactacaaatctaattcatatagctcaccgatgctctgtggacaatgtcatttaaaaagtggtgctttcttctttaattgacccactgttcacacattcagctttatgttatgctatggttagatattaagttaggacgtagacaaaagaaactagtaagccaagtatccctctttcatagcagagtaagagacaaactaaaaagctatcaaccagagactaacatcgtgaaaaatcttggaaaccctcttaagggaactcttggaaaagtagtttaattacagagaacaatctcaattgctgcaggaaaagccattcctaactaacctgccagggcacttcagagatattacagccttgatacgagaaagtcaatacacatcaaagctcaaagatatatgttagagcccatagctatgatgccttttgaatctgctcagcgccatccaagcaagtggtataaattcaagattatttggcttatatttaaaatgaaaaaggcatgtttgcattccagtgcacagataaaagtgctctcttcctctagggatgaatatatcctaaccagtttaacatactttagtttggatttctgtttggtacagtaacaatgtagaccctgctaaactttatgtaatccacagtagatgtaatatattcagattttcaaacagacctaaaaagatttaacctctgagattgctgttaaaaagaaaaccttctgtactagaaagtagaatgtgtatgtagcagcatcagggagaagaaagaagatgtatattaaggaaagaatgagaagtcaccaataggaaaatttgtcagaataagttaagagtagggactagttgaaatctcctaggtcttttcagtttagcatttccttctctagagggaaattctatgaagtacttttctattataaacttgaatttctcatcctaatactttccaaataaaattattttacactaacattcaacgactgatttaaagtacagggtctggaaatttggggataaattgttttaaattttttgcaggttgctgaattctgagatgtttttgctctaactattctttctctataaaaagagcttattttaaaaaaaattttcattgacatataataattatatacatttatggagtacatagtgatgtttcaatgcctataatgtatggtgatcagagcagggtaattagcatatctaccatctaaaacatttgtcatttctttgtgttgggaacattcagtttcttccttctaggagtttgaaactacataatatattattgttaattatagtcatcctacagtgctagagaacaccagaacttattcctcctatcttgctgtaactttttttttaagagacagtcttgctctgtcacccaggctggagtagtagcacaatcatagctcactgcagccttgaactcctgggttcaagccacccccacacttcagcctcccaagtaactgggactacaggcgcatgccacaaaacaaggcttctagctttaattttgtaccctttaacaaatctctatcaccttcttccccctacccttctcagaccctagtgtcctatgttctactttttacttttttttatgttttaatgttttgtataattacagtgatatttgttccaaacctcaaactgggacacttaatataacaaaagattttaaacattttgagaatttttaaaattttaacttgttattttgaaataactttagacttacaaaagagttgtcataatgatacagagagtttctgtatatctattgcccagctttctcaaatgttaacatcactaatgttaacatcctacataaccaggtatggttatcaaaactaagaaacgaatatttgtgtagaacactattaacaaatgccagactttattagagttctaccattcttttttaatggatgtccttattctgtttcagggtccaatcaaagatgttatgaaacattttgtggtcatcttcttttgtctcctcagatctgtgagaattctgtgagaaagacagtctccatctttcctgttctttcataaccttgacatgtttggaaagtccctcatccacgtatgacttagaacatgcagtttttaactgtctgttcctgacttatttcacttaacagtgtcctccagttccaaccatgttgctgtgaatgacaggatttcattctttttatggctgaatagtgttaatggaatatatacacaatggtgtatatataccacattttttatttaatagatcattttatgccctttagaatttatttagttgctatcataataagtaacatataagggcaattccattgaagcattctggactttggctaggtaactgaacaattatgagatacatgtcaaataatgggcacttgatacatttctgttgccatttgtcattttcaattgtcgtttgtctacattgacaaatgcagagcttcttcactgtgtttgtgtacctaactgcatcaaccatttaaaaggtatctaaaaatctatgtctaggaattctaaatacaagatttgaccttttgtggaaaatactacatatgtcttaaaatatttctctgtttaaaacataatattacattattataaagttgccatgagcataattctgtcttttattttttaatactcatccaaagaccacattgtatagtgaaaatagcatagaagtaggagtcaggatgcctgtgtttcagctctagccccccgcttggacaagtctcttaaaatcctcaagcctcagattcatcttctacaaaacgaaggtgatataacttccttgcctagttcacagggcaactatgatcattatatgctatgatccttatgaaagtgtttataaattgaaaggcattatacaaagatattaatatagttaaatataaacaagaatatggcatataacccttggtggggaaaatggactaaaaatatatttagaaagtatcatgcgaatatgaacatcacattgcttttcccaaaggtaaagcaaacaagtttatactttaaaggctcttggtaattttttaaataggatcaataggtgacaggtccacacttaatacaagccatctgatctagaataggaaatccaagactttagagtacaatgaggtgaaaatcctaaaccatgagtagagcatagaattagtctggagaggccgggcgcggtggctcacgcctgtaatcccagcactttgggaggccgaggcgggcggatcacgaggtcaggagatcgagagcatcccggctaaaacggtgaaaccccgtctctactaaaaatacaaaaaattagccgggcgtagtggcgggcgcctgtagtcccagctacttgggaggctgaggcaggagaatggtgtgaacccgggaggcggagcttgcagtgagccgagatcccgccactgcactccagcctgggcgacagagtgagactccgtctcaaaaaaaaaaaaaaaaaaaaaaagaattagtctggagagcaaacagaacacttacagtaggggcattatgcctgttatcaaactaatctaatttctatgtaaggcaatgttcttttgtattttgctgaagaagaaataagaggaatctgagaggtcttagaaactaatttttgaaagattatattttcattcaaaatggatcagataaagttctaaagtctaagaaaatctaaggtacgatgtgagcaacatgaaatttttcattccacttagaaattctgaaaaaagagaacatactataaccagtgaaatgggaatgaaaattcaagtaaaaccttttcatgaaagattattcaataaataaaagaatattcctggagattaactgtaatcttccaagaggcataggtgcataggtggctcctttcatgggttgtgtataaaagttaattcaacaaatatgcattgagttagtacctaaaatatcataggtaatagggaggaaacagtatgtggcatgacctgtacttatgaaagactaaaggatcaatatcttttacaactaagagaaagtttgatatactcaactgtctaaatgaatggtacatattctatatgcacagatgcttccacatttgttaatgagtactaagggcaaatagggaagacgaaaacagtaggaatacaaaagaagggtttcatgaagaagtggaggccagagactggtcttacagaactgatatgatttgagtaagggagagagcaactactataaatggagcaaattccttatttgcaatcttggaaggaaatctttaagaagttactttagtcttcatttttctatttcactttgtactttttagtgactaaaataggttagcagagagcactaagagaaatataataccaagaattagaatcctaaaacctcaagggcttcaggtaccatataacaaatctattgccctgaactcaagctccattaccacagtcctgatgactgtctctctgctgattgagtatctccttgaaccaagagctcaccattttatgaaacaattcccttccttgtttcagaatagtctacagatatgaactgaagatcattaaagtattttaagtacacaaatcaatattcccatttgctagccataaaaacactgaaaagtcaaggggaaacatctgcataataaaattaaagactttcatataacttttaggtttcaaaatgaaactacgtgtaaggagactaaaacccagactttcctaaggccacaaagcaatttagtggtaaaaacattctctataaattcaatcttcttaacatctttccagtatgtgttactgtcccacatattctaatccaaaagactctattttgtgtttcatatcaagaactacatgctctgctccacagccttctgaaaatgaaaaaaaagaagtttaatgatctattcagatgtgtttcccttccttcgtgcactgtaattatttccaataaaaatttaaggaggttaactggaagatctgacacaaagcttgagctaaatgtaccaccctctcctcataccaccaccctcccctgaccctctttcatataaaaaatagtacattttaacttcaaagaagttcctgttatctgtgtactctctgcccatggaaattacatatacaacatacatacagtctccagatactccatttctatataggcactttcaaaggaggaactcaggcattaagttctttctagaattgaaaacgctcactcagaaatagcacctccagccctttctgacaggtgaagccctgtctatcaatcattgccctgctgccttgttttctttctttttttttccagtccagtgtgatcaactgaaacaatatcactatccagctctgagcatattcattttacttacatgtacattggaagttctttggtgactaatacttaaaattatatcagtttacttaaaccatgttcaatgaaaaatagataatcaaaaagatttttttccacagaagctgtttgactaacagtttatgagaattcaatgttagtttctttcattctaactttttaattatttttaactaaacatagttaagaaatggaggtttctgtcagcaatccaagtctctcaagttttccaggatgttttatctactgaattcttgaaatgtctactaagaacagtgcaataatttccataagcaaaggatgcctaccagtacagaacccaaagcactaagccctgctaaggcacagcattcacatggcacactaaacaaaaattttaacaaaattgtattcatttttatcaatttataatttatcctatcaattttcaaaaaactttaaaacagtgtaggataaatacatgtataaaataagcagaattaaaataaaaatcaactaaaaatcaactaacaaaggttcatgtgatagaaattatattagaaaaatataatatgtatttgtaggaactactaaaattaaggtttcattaattgttatgatcttcttgacaacatggctctcatcatctgctataagtggacccatctgtttcttactatacatacatttatacatgtatgtgtatatgcctccctgtgttggtccatttgcattgttataaaggaaataacctgaggctgggtgatttataaagaaaagaggtttatttgactcatggtttatttggctcattctgcagggcttctggtgaggcccaggaagcttttactcatagcagaaggtaaagggggagccagcatatctcatgatgaaagcgggaacaagagagaggagggggtgccaggctttcttaaacagtcagatttcatgtgaactcatacagtaagaattcattcattatcacaaagactgtatcaagccattcatgagtgatcagtccccaagacccaaaccctaccactaggcccacctccaacattggaggtcacatttcaacacaggattttgaaggggcaaaacatccaaactacatcactccataagttgttaatgcagtgtttatcaaaggcatgacttaatgtaagtcttggaactgtattcattgcttagttttaatgttacatattatacatattatataatctctattaataaattctcattaaaaattaagaacaattaattgttaatgtactaggtgatttgtttaaaataaatttctaaacaggaagtataatgttctcattcatctatttattcatttattcaacaggaagatgaaaaagccatggtacctaccccgtggcaagcaccgtgaacaaggcattacatgcgtaatgctatttaatcttcacaacagtcgtggtaagaaagtattgccatacccatcttacagctgaggaaactaaagctcagaaagattagaatataccagtaagtagtggagttgggacttgaactcatttgcctagctgcatattaagattctcaccactacataatgtagtctcacaacaagtactaacttaccatttatgtagtaccaaagaccaacttaaaatgtagtgtagactcagaatcacaactagaatgtggtccttgatttttaaggtgtttacagtccactttacctcactaacctaactagagctatgctaggcatatcttggagttcaatgattagttaacaataaatttaaatatagaatgagtcagtagatataatattgagtttctattatatggcagctgcatgcaaaacattgtatatgatgaataaggtgaaaataacccacttctaacattaaacagtgacgtttactagaatctttgatgtaggtaacagagaagtaaaaataatctgtagttgctttttaactttttccttcagactactgaggaaattatgttccacttaatatcaaaccagctttcttgatttattttctaagccaaggttaatgctcttatactaagggtcactaacagattccttaccatttacaccattagattgtatagcattaagataaatctacactagcgtgagaaacattactgttttgctccttatcattacttatatatgtatatatcaccttgtgccagaaaggatataaagtgttttataaggatacataaaacacaaattagcataaatttaaagttggttaaaaaaaaataaaggtaaagacaaagtaaggtcgctatacatcactgtggtggctgcaaatttggctcctttctttctagcaacctacctgaaataagaaaacttatcacttattgaatttacaattccaaaggtatttttctcattgcttaaggaatatatgatatccttggaattaagatgttttaatttctccaaacctcttttaaaaatatgtgacctaataaacaactattttcatgcttcatccactaaatatatgcattatcttcatagacatggtttttcttgttccaggaataaaagaaaaggtactgagttacatgtttgcattcttctagattcccactacttacacacacaccacccactaaaataacagattcttgtttgtttgataaattcccaggtcttcttccattgtgcaggctcaaagttccaggggagcccaaaactgaaacagctccctaaggctaggcagaactgtttaataaaactctgagccagtgaagaaagggaacaaatacaggaagctcgtatgactcagtttagagaaaaagctttctgagagcttagaaatagagcatggaatgagaggaagaaattaggcagctgctacatatagaagattgtaaaaatgagagaataaggaaaaaatatttaagaaagccttactgagtattatgcaattattcccctttgcctatttgataagaaaaagtggtaaagatttgaatttcttttcaattatttttgatgctactttgttgcttctttcaatgtgaatgccaccaaaaaggcctattttgataagaaaaagtggtaaagatttgaatttcttttcggttattttacatgctactttgttgcttctttcaatgtgaatgctaccaaaaaagggcctattttgataagaaaaagtagtaaagatttgaatttcttttcaattattttatatgctactttgttgcttctttcaatgtgaatgctaccaaaaaagggaaagagatggcttgctttatgcagcttatagtctaatgacctcagtatagaataatggcatcccagggcctcctgtggctccagccatctgcacacttgtggttgacaagggacttctccttctgtccagaattcacttatgcaagaatgggactttttaattttttcaaacctcagaagttttctttcagaaactagaaaaagcataataaggaaacttgaaccaaaaagaacacttctacctaatatagtttttgaggtgcccctaatctctattgagacccagaatctttcagtgatcacacattcatcaaagtaatggttttcagccttcttcacaaactctaatagaataaagtttgcaccactgttacctttgattgtacaaatatctatatgtgtatagttaaaaacactagtttaaaggaagaaggaatcatatataggagaattacccaactcttcacccttttttttctcttccccacttcattctcctaaaccaaggctgcatgtgaaacttgagcattctgagcgcaaagcaacagcaccatcagagcaagacagctgtgtccaggaactacattcctacagagggtttggcagccagtgtggtcccacagtgcctggtggggatataccctgaaggatctcaaaaaaaaaaaaaaaaacctggggagtgttggaggacagcagaagtttcacagtcatgcaagtggaagctaccagcctgtgcacgggagctttaatattaatgtgacctcctggtcacatacagtgcagtaaagggacatttaaataatatacaaaatggaaataccatcaccttatctgcttatgtctctacattgtttcgagcatctaaaaatgaaatgcataaaaaggcactcagaaactataatgtacaatataagtatatgccaatattctaacttccaaataaaacttactcataaattaggtatagggttagacctgattctgaattctttacattgccatgcaccatagggaatgtgcttctaaaaatatgcaataagttatttggacagtctgacgaaagcataaggagttcttactttttataattacacattgaatttcatctcatttatttacgttcggtcctgttttcaactacttggaattcttctgagcagaaatttttctttatacagacattacataactcacaggtctcaggctactcaccccctccatgtccatctccttctgcccctctaacataccacataccacccttcttaccctctcttcagatggtaaaatgggcgtttctcacattcttttacctaagatctgacttcaacacttgtttgaactgagttgaaagccttcattaaacatcagcagaaaaaaagactgacaatagatcctagggggaagtgaacaaaaaggaaagaaaaacaaagcactgaggaagatcatcttaaaggaaaaagatagaaaaagtcttatactttaatcccaatggcctttgtatatgttttaagaatagtgccagaacacgaaaaatgaggggtttcatttacttatgactgaaatactgagaatgataaaggtaggaaatagtgtctgtcacttaatgattacatgactgataattaccttaagaaagttggccatgcacattaacatgagttccacataatgttaataacaaagcaaaccacaagttcctttttggttaattcaagtctgatcaaaagcaagtgaaagcacatacaattctcacaaaagttaagtatttgttaagacctcattccaaaacctccgtcctaccttcctatccttctttaaatcatctgaagttctgatctgtaacaagaagcccgttagttgagggaggacccaagacggccgaataggaacggctctggtctacagctcccagcgtgagcgacgcagaagacgggtgatttctgcatttccaactgaggtaccaggttcatctcactagggagtgccagacagtgggcgcaggtcagtgggtgcgcgcaccgtgcaccagccgaagcagggtgaggcattgcctcactggggaagcgcaaggggtcagggagttccctttccgagtcaaagaaaggggtgacggacggcacctgaaaaatcgggtcactcccacccgaatactgcgcttttcctaggggcttaaaaaacggcgcaccacgagagtatatcccgcacctggctcggagggtcctacgccccacggagtctcgctgattgctagcacggcagtctgagatcaaactgcaaggcagcagcgaggctgggggaggggcgcccaccatagcccaggcttgattaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcagtggttctcccagcacgcagctggagatctgagaaccagcagactgcctcctcaagtgggtccctgacccctgacctctgagcagcctaactgggaggcaccctccagcaggagcacactgacacctcacatggcagggtattccaacagacctgcagctgagggtcctgtctgttagaaggaaaacttacaaacagaaaggacacccacaccaaaaacccatctgtacatcaccatcatcaaagaccaaaagtagataaaaccacaaagatggggaaaaaacagaacagaaaaactggaaactctaaaaagcagagggcctctcctcctccaaaggaacacagttcctcaccagcaacggaacaaagctggatggagaatgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgacgtgagaagggaagtttagagaaaaaagaataaaaagaaatgagcaaagcctccaagaaatatgggactatgtgaaaagaccaaatctacgtctgattggtgtacctgaaagtgatggggagaatggaaccaagttggaaaacactctgcaggatattatccaggagaacttccccaatctagcaaggcaggccaacgttcagattcaggaaatacagagaacgccacaaagatactccttgagaagagcaactccaagacacataattgtcagattcaccaaagttgaaatgaaggaaaaaatgttaagggcagccagagagaaaggtcgggttaccctcaaagggaagcccatcagactaacagcggatctctcggcagaaaccctacaaaccagaagagagtgagggccaatattcaacattcttaaagaaaagaattttcaacccagaatttcatatccagccaaactaagcttcataagtgaaggagaaataaaatactttatagacaagcaaatgctgagagattttgtcaccaccaggccggccttacaagagctcctgaaggaagcgctaaacatggaaaggaacaaccagtaccagccgctgcaaaatcatgccaaaatgtaaagaccatcaagactaggaagaaactgcatcaactaacgagcaaaataaccagctaacatcataatgacaggatcaaattcacacataacaatattaactttaaatgtaaatggactaaatgctccaattaaaagacacagactggcaaattggataaagaatcaagacccatcagtgtgctgtattcaggaaacccatctcacgtgcagagacacacataggctcaaaataaagggatggaggaagatctaccaagcaaatggaaaacaaaaaaaggcaggggttgcaatcctagtctctgataaaacagactttaaaccaacaaagatcaaaacagacaaagaaggccattacataatggtaaagggatcaattcaacaagaagagctaactatcctaaatatatatgcacccaatacaggagcacccagattcataaagcaagtcctgagtgacctacaaagagacttagactcccacacattaaaaatgggagactttaacaccccactgtcaacattagacagatcaatgagacaaagtcaacaaggatacccaggaattgaactcagctctgcaccaagcggacctaatagacatctacagaactctccaccccaaatcaacagaatatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaaaccgctcaactacatggaaactgaacaacctgctcctgaatgactactgggtacataagaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacactcaaaagctagcagaaggcaagaaataactaaaatcagagcagaacggaaggaaataaagacataaaaaacccttcaaaaaattaatgaatccaggagctggttttttgaaaggatcaacaaaattgatagaccactagcatgactaataaagaaaaagagaagaatcaaatagatgcaataaaaaatgataagggggatatcaccaccgatcccacagaaatacaaactaccatcagagaatactacaaacacctctatgcaaataaactagaaaatctagaagaaatggataaattcctcgacacatacactctcccaagactaaaccaggaagaaactgaatctctgaatagaccaacaacaggatctgaaattgtggcaataatcaacagcttaccaaccaaaaagagtccaggaccagatgtattcacagccgaattctacaagaggtacaaggaggaactggtaccattcctactgaaactattccaatcaatagaaaaagagggaatcctccctaactcattttatgaggccagcatcattctgataccaaagcctggcagagacacaaccaaaaaagagaattttagaccaatatccttgatgaacattgatgcaaaaatcctcaataaaatactggcaaaacgaatccagcagcacatcaaaaagcttatccaccatgatcaagtgggcttcatccctgggatgcaaggctggttcaatatatgcaaatcaataaatgtaatccagcatataaacagaaccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaaccagaagcattgcctttgaaaactggcacaagacagggatgccctctcttaccactcctattcaacatagtgttggaagttctggccagggcaattaggcaggagaaggaaataaagggtattcaattaggaaaagaggaagtcaaattgtccctgtttgcagacgacatgattgtatatctagaaaccccattgtctcagcccaaaatctccttaagctgataagcaacttcagcaaagtctcaggatacaaaatcaatgtacaaaaatcacaagcattcttatacaccaacaacagacaaacagagacccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccacgctcatgggtaggaaaatcaatatcgtgaaaatggccatactgcccaaggtaatttacagattcaatgccatccccatcaagctaccaatgcctttcttcacagaattggaaaaaactactttaaagttcatatggaaccaaaaaagagcccacatcgccaaggcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctgtttaataaatggtgctgggaaaactggctacccatttgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagacaaaattgacaaatgggatctaattaaactcaagagcttctgcacagcaaaacaaactaccatcagagtgaacaggcaacctacaaaatgggagaaaattttcacaacctactcatctgacaaagggctaatatccagaatctacagtgaactcaaataaatttacaagaaaaaaacaaacaaccccatcaaaaagtgggcaaaggacaagaacagacacttctcaaaagaagacatttattcagccaacagacacgtgaaaaaatgctcatcatcactggccatcagagaaatgcaaatcaaaaccacaatgagataccatctcacaccagttagaatggcgatcattaaaaagtcaggaaacaacaggtgctggagaagatgtggagaaataggaacacttttacactgttggtgggactgtaaactacttcaaccattgtggaagtcagtgtggtgattcctcagggatctagaactacaaataccatttgacccagccatcccattactgggtatatacccaaaggactataaatcatgctgctataaagacgcatgcacacgtatgtttattgcggcactcttcacaagagcaaagacttggaaccaacccaaatgtccatcaatgatagactggattaagaaaatgtggcacatatacaccatggaatactatgcagccataaaaaatgatgagttcatgtcctttgtagggacatggatgaaattggaaatcatcattctcagtaaactatcacaagaacaaaaaaccaaacaccgcatattctcactcataggtgggaattgaacaatgagaacacatggacacaggaaggggaacatcacactctggggactgttgtggggtggggggaagcaggagggatagcattgggagatatacctaatgctagatgatgagttagtgggtgcagcgcaccagcatggcacatgtatacatatgtaactagcctgcacaatgtacacatgtaccctaaaacttaaagtataataataaaaaaaaaataaataaaaataaaaataaaaagaatgtggccatgatgacagggaggaagatttacctcagacctgcagtatggacttctactcatcaatatttactggtcacagaaactgctgaattcaaaatctgccaacaataccatctgtgtgctacagaataccttattcaggatcatattattactcataccatcattgttgaccaaggaatttattttacagcaaataaaatgtggcaaagggcccttgctcatgaaattaactaatcttgccatgattttcttcatagcatggataatagtatggtggaatggctttttgaagactcatttatgatgtcagccatatggcaacacttttcagagctgaagtaatatccccagtatattctgcatggtcagcatacatgtgtggtgccatatcgcttacagtccaaatgtatgggtcaaggaatcaaaaggagggaaaaaaaattagaatgtactatcactatttcttcaggtgatatactagcaaacttttgccgctcattgccattattttaggccctgtgagtttagagatcttaatttcaaaggaagtaatgcttctatcaagtgataatgcaataatgattgcattgaactagacattgagacttgacccagccaaattagggccttcaattaacaggcaacaaatggggtttctgtactagttggagtgattcttctagctatcaaggtaaaattaggtttctactaaaaaataaaaagatatatatacctgaaatggaggagatcttccagagtgcttattagtattctcatttcttgtgattgaaatcagtggaaaactagcacagctcaattcaggatggactgataatcacccagatccttcagcaataatgatttaggtaacttcatcaggcaagaaattaaacaaactgaagttcttgctgggggcaaaggatataaaaatggtagtggaagaagctgtttaaacataccagctataacgatgagaccagttgcggatatatggactaacttaattatgagtatttcttatctttatataaatatgactcttttgtgtgtgtgatatcacatacacaatgtttactttattttctttcttccctcattccctaatcatgtaaaataagatgtgttaataatgcttaactttatatctcagtatttaaggtacaccgtatcaataatggagcatgaatagaagaatgaatatcaaaaaaaaaaaaagaagcccgttagttaaatcagtatgggaagtgggcaatgctgtaaaacagcagctgacatcagtattgtaaaatacataaaatctttcataaaatgaaagatagcacagacagctataagaggcatgtttgctttgaaataccccttaagaatcttagcactacacagtacctgccacagagttacctttttacaaagaaagagtaattctccaaaatcttacaacatttctgcacaatactggctaaggtcattctgatccagtatgacccagccagatattgcattataatacctgtattagaatgacaattctcacctccaggatgttagtaaaataccaatctgattactaattcaaacaaaaatacagggagggagcatcaaatatccataaaaattatttacagcaactgtagttattcaggtcatttttacagaaagcctatcccctgggccaatgtatttgtggcatttttttttattactacatagctcaaaagtgcctttcatgctcagcaggcacatcataggcaaagaactgacaaattgaaaagctatcataagaatataaatcaaaaattctataaaatttggcttatatgcccaaagatgtcaaaaacatgatatactacatcagttattcaccatcaacaaaaagaaacattgaaagcatctattttaatcctgatttttacacttgcagattttcccccaccaaatttatcttaaataattcttaagtacactttctcctcatatatattttattggctttcccttaaacatgaaaaattatagcagtttctctacacatctaatcaactcatttcagtaaaaaccataaccaattaaaatttattctcaaaaaaaggaatctaattcttaaccataggctaatgatgcttaaaagaattgctttgcagcttgaccagcagatgggacatcactttagactgcaacacaaggagaaattgatgagaaaaaactaagagactttctgttaggagaaaaactgtaagggacaccacaggaaggagccatttataatcattttctcctccacataatttaaagctgtgggccaggagccaaatgatggcaaggaacacacctcccaccaagcaagaattaagataaccagctctaatataagcaacacaaaactaattattctcataaattcccttcatagtgttaacacaaaacatcaacactatggtgctgacagcagcaggcagggaagtggtagaaaatttagatccagcactttcctttaaacttagattagtacatcatagcaatatctatattggaaaagtacaaacagaactaacagaagcataatggaacaaatttcagaatgtgaatagtaggaaacattttcagattataacaacatatattctaaatgatgacattacataacaacaatagttaagattttttaacatttccattaatcccactatccaatttaatcccccaacaacctatgtggatagaattatttccctactttacaaacaagaaagtagaggatttcagggtgacctcaaggcaataattagtttaatggcaaagccacaagtcttggtttccatttcagagctctttccaatatattaagctgcctatctatgtatattttttagtattattaacagtaaatattaaattaacatttaaaaacatcactttaaatgtatgtttgtaaaataaaagcagagtatatttttaaagaaagatcattgaaaattttaaatgacataaaaatttctttagatgattactgtaaccaaaaagaaataatcacaaaactatctgaaagcaaataacaacatcaacttgtaaacatcaattattcagaaaggaaacagaatatatcctaggaagacacaaagttgaaactcaatatgaatctagaaaaataggattatatgtttaaacttataatttatttgatgatgacactataaaaaagaacattcaaataaaatattaaataagatgcttctgacatttgactaaattcaatagatattatcattattaatatggtatcatcatcaaaattatcatattggtaaaattatcattccagctatgtaatttgatcatgttttattataagcatcaaaatcaatgtacagatgaccactgaataacatgggagttaggagtgtcaaaccccacacagattttcagctgcatataactttcaacttccccaaaatttaacaggaatgtctactgttgatcagaagccttaccaataacataaacaattaacaaacattttgtatgttataaagcaagctaaagaaaagaaaatgttgttaaaacaatcataaaaaagagaaaatatatttattatttgatatggtttggctctgtccccacccaaatctcatcttgaattgtagtttccataatccccatgtgtcatgggagggacacggtgggaggtaattgaatcgtgggggcagttaccccatgctgctgttattgtgatagtgagtgagttctcacaagagctgatggttttataaggggctttcccccgttttgattggacttctccttcctggcaccatatgtttgcttccccttcgccatgttgtaagtttcctgaggcctccccagccattctgaaccgtgagtcaattaaacctctttcctttataaattacccagtcttacatatgtctttattaccagcatgagaatggactaatacagtatattggtaccacagagagtggggtgctgctgtaaagacacccaaaaatatggaagcaactttggaactgggtcacaagcagaggttggaacagtttagagggctcagaagaaaacatgaaaatgtggggaagtttggaacatcctagagactaggagagctcagaagacaggaaggtgtgggaaagtttggaacttcctagagatttgttgaacagctttgaccaaaatgctgatagtgatatggacaataaagtccaggctgaggtgatctcagatggagaggaggaactttttgggaactggagcaaaggtgactcttgtcattctgtaacaaagaaactggcagcattttgcccctgccctagagacttgtggaactttgaacttgagagagataatttagggtatctggcagaataaatttctaagtgacaaagcattcaagaggaagcagagcataaaagttcggaaaatttgcagcctgaggatgcaatagaatagaaaagcccattttctggggagaaattcaagcctgctgcagaaacttgcataagtaacaaggccaaatgtaatcaccaagacaatggctaaaatgtctccaggccatgtcagagaccatcacagcagcccctcccattacaggcatagaggcctaggagaaaataatgatttcatgggcagagcccagggcccccctgctgtatgcagacttgggacttggtgccctgcatcccagctgctccagacatggctaaaaggggtcaaggtacagctcaggctatggcttcagagggtgcaagccccaagccttggcagcttccacatggtgttgagcctgtgggtgcacagaagtcaaaaactgaggtttaggaacctctgcctagatttcagaggatgtatggaaatgcttggatgtctaggcagaagtttgttgcagaggcagagccctcatggagaacctctgctaggaagtgtggaagggaaatgtggtgtgggagcccccacacagagtctccactggggcactgtcaaatggagttgtgagaagagggccactgtcctccagaccccagaatggtagatctgctaagagcttgtggctggaaaagcagcagacactcaatgccagccagtgaaagtagccaggagggttgctataccctgaaaagccacatgggcagagctgcccaaggccatgggagcccacctcttgtgtcagtgtaccctagatgtgagacatgaagtcaaagagcattttggaactttaaggtttaatgactgccctattggatcttggacttgcatggggcctgtagcccctttgttttgaccaattttgcccacttggaacaggtgtatttactcaacacctgtacccccattttacctaggaagtaactaacttgcttttgattttataggctcataggtggaagggacttgccttatctcagatgagactttggacttgtacttttgggttaatgctggaatgagttaagactttgggggactgttaggaaggcatgattgtgttttaaaatgtgatgacacaagatttgggaggagccaggggtggaatgatatggtttggctgtgtccctacccaaatcttatcttgaatttagttcccataatccccacgtgtcatgggagggtacctggtgggaggtaattgaatcatctgggtggttacctctacactgttgctttcatgatagtgagtgagttctcatgagatctgatggttttataaggggcttttcccccttttgcttggcactcctccttcctgtctccacgtgaagaaggacatgtttacttccccttctgccatgattgtaagtttcctgaggccttccagccatgttgaactgtgagtcaattaagcctctttccttcataaattacccagtctcagatatgtctttattagcagcatgagaacagaacgaatacactattcattaagtggaagtggattatcatgaaggccttcatccttgttgtcttcacactgagtaggatgaggaggaggagaaagagaaagggtgggtcttgctgtctcagtgggggcagaggcagaagagatggaggaggcagaaagggaggcaagagagacaggcaccctccatgtagcttttattttttaaaatctacatataaatgcacctgcacagttcaaatccttgttgttcaagggtcaactataaacgaatttgttagagtgacagacaagtaccacctttgctcaaattgtaaaaccaatattattaattttatagcattttatcagcattttttcattaaatgaatatacaattgtcacattaaatcccctagactctcatcaaaattgtaaatcatttcattagtaatcaaataaaatttgcagtttttggctaagtcattgacaacactccatgctctgtcccatcctaactctttcaacaccattttctaccatgtaatccaaatatactgggcattttatgctttctcacttttacaacatctcccaaggttttttccaggtagaacaccctccatttctccttgttaaaataatacctgatcttcaccacccaactcacatcctatgtccttagttcagacttccctgatcctgtcaactgttggagatcttttcctccattaaggtacttaccaaagtttgtcttatgtttctgataattttcataagtctcaaataactataagcattatggtaaccaagactgttttaaacttttgtatctcccaaaatacttcagtaccatagatcaagtacacattcatgaattctgcatctactacatagtcagaaaagtggaagaatttctatagttatattttaattacaatttttttttattatactttaagttttagggtacatgtgcacaacatgcaggtttgttacatatgtatacatgggccatgttggtgtgctgcacccattaactcatcatttagcattaggtatatctcctaatgctattccctcccacctccccccaccccacaacagtccccggtgtgtgatgttccccttcctatgtccatgtgttctcattgttcaatttaattacaatctttaaaatcacagaaactcttgaatacatataccaaaaccttcaagatgccaataagaattttactctgttgtgagtgcttgtcatttgtaactatattgttcccacatctaacaatctatcacccataaacatgtcaaagtactgtgacaaagtataacaaatgattctccaatattttgaatagatttacttttaaataaatgttacagatgtattatgaaataagaaataagcttacaaatacatttattttaacatcttgtgttgattatgagaacaataaaaatgagcaattcacgggaaaataatttcagatagattttgtctccctacaaatgggcatcctgatattcactctggaataaatactttaggaagaagatgatattgagatcatatccctttgtttggtaatcaaaggcttatttttcatgtggaaaattttaagtgctaataaataatccactgcaaaccacataatttttgaaaataacccccaaattatatacacaaacaagtaaattttagtgaatgtatgcaattgctattggcagttattagatcctaattacttttcaaaagtggaattaataatatgtaatttaatgtcttacaggatattataaagatgtaattttattggactttgcttctaatacactgaaccataaggctaaatttaaaaccacttagaaaagaatattagaattaaattacagagaaatttacaactaaattaagaaactctatcaattaaaaaactttgctgtcatcctcaaatgtgagtgcttatctaataatatgatcctggactaagtgttgtgtatacttcagatataaaattttcatataggctattcctaggcaaatacaaaaagtaaacaaaaacaaaacaaaaaatactgatgactagtgatcacattaaaataaatgacatcataaaagtgacccttttccccttccacctcccaccacattaggacagcaacagagcatcagcttggaagcaaaagcagccctcacaagatcacacctgtcagtgccttgatcttgaactcctgagcctccagaactatgagaaataaatttctgctctttaaaaaccacccagtttcagcatatactgaaaattcaaaacttgccatacttttaaaatatagattgggactagatacagtcagaaattgccactcccacagaaagagacccaatttaatatacaccaacataatttgaacaaatcttcagagagaaactaccaaacatggattgagaaaagatgcagtcccagagactgaagaagaaggaagttaggcacccaatgtggggtgcctgaatgctaaggctgatttccaaactggaaaggtacctggggaaggggattggtccagtaaggatatgggttatttccataccagacctctccctaagggagccccgtggccccaaagacctaataaaaacaacaacaaaatcgaaggtacagtgctagtgattggatgtggctcccccaagcagacctgatgagggggtcatctatttcccccttgcactgcagaacacagctgcaaatgttaacatagacaaaggaaccacaaggctgagtagaagcctatctactgcccattgctctcaaggaccatctactagattgtagcccaaactacaacaccaaaatcactttactaatcctgcccttgcaaaaccaagagtaagaattctgcaacgaagacaccatacagagccttagttctctaaaaactttcagaaacaaagccaacaaagtacactcaatttacaccacaattaaaagaataccatccctcccagatgagaaagaatcagcataagaactctggcaattcaaaaagccacactgcccccttacctccaaatgagcccactagctccccagaaatgtttcctaaccagtctgaattatctgaaatgacagacatagaattcaaaatatggatggcaaagaagctcattgagatcaagaagaaagttgaaactcaatccaaggaagccaagcaatccagtaaaatgattcaagggctgaaaggtgaaattctcacttaaagagagacaaaaacttaatttcttgagctgaaaaattcactacaaaaattacataatataattggaagtattaacagcagaatagaccaagctgaggaaagaatctgagagctcaaagagcaattctttcaattaacacagtcagacaaaaatacagaaaagagaattgagaaagatgaagagcagagagtgggccgagacctccaattagaagtagctatggtgcatggcactcataaagaggaagaaaagcagtgagtaaatacagcaccttcaactgaaatatccaggttttcgcactgggactgatcagggaaataaccaatccacagaaaacagagaaaagtagggcaggatgatagcccacctggaagtgacgcaaagccaagggaacccccaccccagccaaggaagtggtaagtgaatgtgccaccctgggaaaccacatttctcccatggatctttgcaaccctcagatcaggagatcccctcataaacccactccaccaggaccttgggtcagatacacagagctgtgtggagtctcagcagggcagccactcaggtatgcacagagacccaggagatttacataccccagccacaggatccctggcaaaggtgactacaactcagtcaaggcgggaggtccatacatacccctaggaagggggccgaatccagggagctgaacagcgtccatctgtgggccccatttccaaggcacctcacaaaataagacccactggcttggaacttcagccagccaccagcaacagggtagtgcctgcctgagatggaatggagctgccagggaaaggggtgggctgtcacctttgttatttggacaactcagctgttcaagtctgtgggctttggagagtccaaacagtctggacaagtaagggacccccagcacagcacagcacagctgctctatgaaaatgtggccagactacttctttaagtgggaccccaatccattccaccccactgggcaggacttcccaatagggacctccagccacccctgcccatattctaggaaagaactctgatctctcccttggctggagtgcccagtggggagggatgagctgccaatgttgctttgagcccattccagcctgtaggctttgcagaatccaagccaatacaggcagagatggatccccagcaacgcatggctgttttgtcaaggtgtggccagactgcttctttaaatagaaccccaatccattcctccttgctgggcaggtcctcccaaccagtgcttccaaccaccctcacccatgttctatggctgacaaagttctaatttctccctgtgatggagtgcccagggggccaggtgggctgccacctgtgctgtttgggcatctcacccagtccaacctgtgggccttggaaagtgcaaaactatatgggggtgaagggaagccaaacacagcacagctgctctacaaaaacgcaggaaggctgcttctttaaggaggtccctgatcccattcctcctgactaggtgagacctccaaaacagggtttccagccacatcctatgggtgcattcaggctggcaacaggtcagtacttctctgggacagagctctgagaggaaggggcaggctgccatctttgctgttttgcagccttcaccggtaatacctacaggtactgaaaaaactgaggtgactagggtctgaagcagccgcccagcaaatcatagcagccctacagaaaagtggtcagactgttcaaagaaaaaacgagcaaaacaacaagaacaacaacaacaaaaacccatccaaaggtcaacaacctcaaagatcaaaggtagataagccaacaaagatgagaaagaatcagcacaaaaacacagaaaactcaaaaatccagtgtgctccctttcctctaaatgaccacaacacctctccagcagggatttagaactggactgaggctgagatggctgagatgatagaaataggattccaaatgtggatctaaaaaatgaacttcactgagctaaaggagcactttgcaactcaatgcaaggaagctaagaatcatgataaaacaatgcaggagctgacagccaaaatagccagtatagagaggaatataaccaacctgatagagctgaaaaaaacacaacaagaacttcacgatgcaatcacaagtattaatagcagaataggccaagcagaagaaagaatctcagagcttgaagaatgtcattctgaaataacacaggcagacaaaaatagagaaaaacaatgaaaaggaataaacaaaacctccaagaaatatgggattatgtaaagagactgaatctatgactgattggggtacctgaaaaagatgaggagaatgggaccattttggataacataattcaggatatcatccaggagaacttccctgacctacctacagaagccaacattcaaattcagaaaatgcagagaaccccagtaagatacttactccacaagaagatcgtccccaaaacatgtaatcatcagatcctccaaggtcaaaatgaaataaaaaatgtcaaaggccactggaaagaaaggcgaggccacctacaaagggaagcccattggactaacagtggacctctcagcagaaaccatgcaagccagaagagattgggggacaatattcaacatttttaaagaaaagaaattccaatgcagaattacatatctagccaaactaagcttcataagagaagaaataagatccttttcagacaagcaaattctgagggaatttgttaccaccagacctgctttataaaagctcctgaaggaagcactaaatataaaaagggaaaactgttgccagcctctacaaaaatacactgaagtatacagaccagtgacattataaagcaactacataaacaagtctgcaaaataaccagctagcatcatgatcacaggatcaaatccatacataacagtattaaccttaaatgctccaattaaaagacacagagtaaaaagctggataaagaaccaagacccactggtaagctgtcttcaagagacccatctcacacgcaaaaacatacacaggctaaaaataaagggatggaggaaaatttaccaaccaaatagaaaacagaaaaaagcagggattgcaatcctagcatctaacaaaaaaagactttaaaccaaaaaatatcaaaaaagacaaagaagagtattacataatgataaagggttcaattcaacaagaatagctaactgtcctaaatatatgtgcacccaaaacaggaacacccagattcataaagcaagttcttagagaccttcaaagagacttagactcccacacaataatagtgggagactttaaaaccccattgacaatattttctaatatctctatcatcaagacagaaaattaacaaaaatattcaggacctgaactcaactctggatcaagtggaactgacagatatctatagaactctacaccccagaacaacagaatatacattcttctcattgccacacatcacttactctaaaattggtcacataatcagaagtaaaacactcctcagcaaatgtaaaagaactgaaatcataatgaacaatctctcagaccacagtgcaatcaaattagaaatcaagattaagaaatgcattcaaacccacataatatggtttggctgtgctcccaccaaaatctcctcttgaattgtacttcccaaaatctccacctctcatgggaggaacctggtgggaagtaatcagaacatgggggcagtttcctccatgctgttctcataatagtgagtgagttctcaggagagctgatggttttataagaatctgacatttcccctgctggtacttctctctcctgccaccttgtgaaaaagaacatgcttgcttccccttctgccatgactataagtttcctgaggcctccccagccatgtggaactgtgagtcaattaaacctcttttctctacaaattacccagcctggggtatttcatcatagcagcatgaaaacaaattaataccccacaaaattacatggaaattgaataacctgttcctgaacaactgttggataaataataaaattaaggcagaaatcttgaaattaatgagaacaaaaatacaacataccaaaatctctggaacccagttaatgcagtgttaagagggaaacttacagcactaaattcccacatcaaaatgttaaaaagatctgaaattaacaacctaacatcacaactaaaagaactaggaaaccaagagtgaacaaataacaaagctagctgaagacaataaataaccaaaagcagagctaaactaaaggagatagaaacatgaaaaacctttcaaaagatcaaaaatccagaagctaattttctgaaaaaaagttaataaaatagactgctaactagactaataaaaaagaaaagagagaaaattcaaataaacacaatcagaaatgacatggaggatattaccactgacccacagaaataaaaacgaccatgagagaatgttatgaacacctctatgcacacaaattgaaaatctagaagaaatggacaaatccctggacacatacaccctcccaagactgaaccagaaagaaactgagtccctgaacagatcaacaacaagctctgaaatcaaatcagtaatgaatagcctatcaaccaaaaaaagcccataaccagatggattcaccgcttaactctaccagaggtacaaagaagagctggtaccattcctattgaaactattccaaacaattgaaaagcagggactcccccataacccattctatgaggccagcatcatcctgatactaacacctggcagagatataacaaaaaagaaaacttcgggccaatatccttgataaacattgataccaaaaatcctcaacaaaatactggcaaactgaatctagcagcacatcaaaaagcttatctaccatgattaagtagtcttcatccctggaatgcaagtttcgttcaacacacacagatctataaatgtgatttatcacataaacagaactaaaaacaaaaaacacatgattatctcaacagatgcaggaaaggcctttggtaaaaattagcatcctttcatgtaaaaagctctcaataaactcggttttgaaggaacatacctctaaataataagagccatatatgagaaacccacagccaatatactgaatgggcaaaagctggaagcattccccttaaaaactggcacaagacaaggatgccctctcttaccactcctagtcaacatagtattggaagttctgaccagggaaatcaggcaagaaaaagaaataatgtgtattcaaataggaaaggaagaagtcaaactctcttcgtttgcaggtgacataattgcgtatctagaaaaccccactgactcaccccaaaagcttcttaaggtgataagcaacttcagcaaagtcttaggatacaaaaatcaatgtgcgaaaatcactaccattcctgtggaacaacagcaggcaagtagagagccaaatcataaatgaactcccattcacaattgccacaatgagaataaagtacctaggaatacagctaacagggaagtgaaggacctctttgagaagaactacaaaccactgctcaaagaaatcagagatgacacaaacaaatgggaaatcattcaacaacaggcaagtagagaaacaaatcataaatgaactcccattcacagttgccacaatgagaataaaatacctaggaatagagctaacacggaagtgaaggacctcttcaaggagaactacaaaccactgttcaaagaaatcagagatgacacaaacaaatggaaaatcattccatgctaatgaataggaagaatcaatgttttgaaaatggccatactgtccaaagtaatttatagattcaatgctattcccatcaagctaccattaacattctttacagaaatagaataaaatattttaaaatcaatacggaaccaaaatagaactcgtatagccaatcctaagcaaaaagaacaaagctagaggtaccacattccctgacttcaaactctactacagggctacagtaacccaaacagcacagtactggtacacgaacagacacatagaccaatggaacagaatacagaacccagaaataagactgcacacctacaaccatctgatattcaacaaacctgacaaaaatgaggaatggggaaaggattccctatttaataaatggttctgggagaactggctagccctatgtagaaaattaaaactggaccccttccttacactatatataaaaatcaactcaagatgaattaaagacttaaatgtaaaacccaaaattataaaaaccctagaagaaaacctaggcagtactattcaggacataggcacaggcaaagatttcatgatgaagatgccaaaaacaactgcaacaaaagcaaaaattgacaaatgagatctaattaaactaaagagcttctgcacagcaaaagaaactatcatcaagtgaacagataacctacagagtgggagaaaatttttggaaactatgtatctgacaaaggtctaatatccagcatttaaaaggaacttaaatttacaaaaaaaaaaaaaaaaaagccattataaagtaggcaaaggactgaacagacacttctcaaaagaagacatacatgcatgtggccaacaaacatgtgaaaaaaagctcaacatcactgatcagtagagaaatgcaaatcaaaaccacaatgaaataccatctcatgccaatcataatggcaactattaaaaagtccagaaacaacagatgctggcaaggttgcagagaaataggaacacttttacactgttggtgggagtgtaagttagtttaaccattgtggaagacagtgtggtgattcctcagagatctagaggcagaactaccatttgacccagcaatcccattactggttatatacccaaaggattataaatcatgctactataaagacgcatgcacacgtatgtttattgcggcactattcataatagcaaagacatggaattaacccaaatgcccatcaatgatagactggataaagaaaatatagtacacatacactatggaatactatgcagccataaaaaggaacaagatcgtgtcctttgcaggaacatggatggagttggaagctgttatcctcagcaaactaatgcaggaacagaaaacgaaacaccatatgctctcacttataagtgggaggtgaatgatgagaacacatgaacacattgaggggaataacacacactggaggctgttaggggtggaggtggggtagggggagggaaagcatcaggaagaatagctaagggattctgggcttaatacctaagtgttgggttgattgtgcagcaaactatcaaggcaaatgtttacctatgtaacaaacctgcaaatcttgcacatgtactctggaacttaaaataaaagttgaaggacaaatattttttaaaaagaaatgcaaatcaaagccacaatgagataccatctcacaccagtcagaatggctactgttaaaaagtcaaaaaataacagatgctggagaggtcgtggagaaagaggaacacttacacactgttggtgaagagtggaaattagttcaaccattgtggaagacagtgtggcaattcctcaaagacctaaagacaaaaataccactggacccagcaatcccattactgagtatatacccaaaggaatacaaatcattctgtaataagactcatgcacacatatgtttactgcagcactattcacaatagaaaagatatagaatcaacataaatgcccatcaaagatagactggattaaaaaatgtggctcatatacacaatggaatactatgcagccataaaaaggaatgagatcatgtcacttgcagggacatggatagagttggaggccattatccttagcaaaccaacacaggaactgaaaaccaaacaccaagttttcacttacaagtgggagctaaatgataataacacatagacacatggggggaacaacacacactgggtcctgtcaaagggcaaggggtgagaggagggagaggatgaggaagaatagctagtggatgctgggcttaatacctgggtggtggaatgatctgtggagcaaaccaccatggcacacatttacctatgtaataaatctgcacaacctgtacatgtacccctgaacttaaaataaaagttggaaatataaaaaatagtgttggcaagagtacagagaaaagggaactcttccacactattggtcagaatgtaaattagtacagccttatggatgatgcttccccccacccaaaaaaaaaaaaaaacccacagaaataaagctaccatatgatccagcaatcccaatatgtaataaagtatgtcccactactaggtatatacccaaagtaaatgaatcagtatttcaaagagatttctgctcccctatgttcactgcagccaagacacaaaatcaacctaagtgtccatccacagatgagtagataaagaaaatgtgttatatatacacagggggaacctgttcagccttaaaaacaaaggaaagcttttgatttgccacaacattgatgagtctggagaacattatgttacataaaattagccaagcacagaaagacaaatactgcatgatcaaacttgtgtgtggaatccagaaaagtcaaactcatagaagcagagtaaaaatagtggttaacagaggctgggagtgaggagatgggttacccagaaaaatgctggtgaaaggatacaaaatttcagttagacatgaagaataagttcgagaaatgtacaacatgaggaccacagttaatggcaatgagttgtgtaccttaaatttccaaagacagcagattttaagtgttctcattacaaaaaaatgaaaagtatatgaggtcatgtgtatgctaattagcttgatataatcattccacaatgtctacatatttcaaaacatcatgttgtatgccataaatatatacaatttttgtcaagtaaaaatttttaaaggccgaatttactcaaaggttaatttaatatgaccaaaactgagtggttcaagggatttgcttataggcatttctaggtcattgactcaattcctttttatggtcatagttttcagtaacttggctctgtgtagcagcccattccaaatgaggatctgtaccctgttatatttctgttttgtccacaactgagaagaatattcattggattgtgtatctgagttaggggaaagtctagtgcttctagaaaactccatgacaactgtagatcaatgcacagttttctgccttgaaacttgaaatttcaattgtaagacaatattaaatagaataaaaaatgatactctggcaaatataacagagttttccttttttgtgggagtgtcagattttgagttttacaggagaactaggccttctaattctgatttgactttccaactaacatcaaacttagagctccatatctgagggataactggactggtgattgtgcaaaatatttctgtcttgcatttaaagttgtaacgaattgatagaaatcaatcttaccagcactggctgtcatttaattcttattcttaactttggtgataaaaaaaaataaatctgttgaatctgtgcaaagaagcctttctgagaccaaaatggcagctaaaattatttctgtaattaatttctgccttgtgtgtcaatgttctttagaatataaatgattttgtaaatacttggcagcaatttgtttaatttggaagggcacaaagtacactccattgagttggcaaatgcaacatccttctaaatatttttcctaaaacatcaagtatattatatgtatttaaatttatattacaacacttttctgagaaagtgtaatttttaattatgacctaagtctgactacatgcatgtctttgccttcttgtttcatgcattcattagcaatttgaatagaattttaataaaattcaacaaaaagaaaaatgaacaaaacatctgagaaatatgggattatgaccaaatatatgattcatcagcattcctaagaaataaggagagagaataagcaacttgtaaaatacatttgaggacacaggcatgaaaacttctctagtgtcactacagacattgacatgcaaatccaagaaatacagagaatttcagccagatactatacaagatgaccctacccgaggcacatagtcatcagaatcaccaagatcaatgcaaaagaagaaatctaaaaggcagctagagagaaagtgcaggtcacctacagagggaatcccaccaggctagaagcagatttctcagaaaaaaccttacaagccagaagagattaggggcctattttcagtgtccttaaagaaaggaaattccaaccaaaaatttttatatcctaccaaactaagcttcataactgaaggagaaataagaggcttctctgacaagcaaatgctgagggaatacgtttaaactagagtagccttacaagaggtccttaagggagttctaaacatgaattcaaaagaatgacacctgccaccacaaatgcacacttaagcacatagctcacaggcactataaagcaactacacaagaaccagctaacaatacaatgatagaatcaaaatcacatatatcaataataaccttgaatgtaaatgggctaaacagcccactcaaaagacacagagtggcaggctggataaaaagacaagacccaaccaatctgttgttttcaagagacccatcttacatgtaatgacacccacaaactcaacgtaaaagtatgcggtaagatctaccatgcaaacagaaaacaaaaaagagcaggtgtcaccattcctcatcattcattcattcttcatcattcaattttcattcttcatctttcatcattcattcttcatgtttcatcattcattcttcattcattcatcattcattcattcatcagataaaacagattttaaacacataaaaatgaaggacaatgaagggcactgcataacaataaaggatacagtccgacaagaagccttaactatactaaatatatacacacccaactttggagcactgagatttatacaacaacttcttcttggcctaggaaaacacttaaacaaccacacaataatagtgggagacttcaacaccctactgacaacattagatcatcaaagcacaaaactaacaaagaaactctggacttcaactcaacacttgaccaaatgggcctataaagcactccatccaacaaccacagaatatgcattcttctcatctgcacacagaacatattcaaagatcaaccacatgctcagtcataaagcaggcctcaataaattcagaaagaaattgaaactataccaagtatactctcaaaccacagtgtaataaaactagacatcaataccaaaatgatctctcaaaattacacaaataaatggaaagtaagcaacttattcctgaataactcctgggtgaacatagaaattaaggcagaaatttaaaaaattatttgaagttaatgaaaataggaacacaacttaccaaaatctctgagatatagccaaagcagtgttaagaggaaaattaatagtcctaaatgccttcatcaagaagttagaaaggtctcaaattaacaaactaactttgcacctacaggaacaagaaagaaagagaacaaaccaactccaaagctagcaaaagaaaagaaataactaaaattaaagaagatcttaatgaaattgagatgcaataaaccatacaaaagaccaatgaaaccaagaattggttctttgaaaaactaagactggtagaatccctaactaaatcaacaaagaaaaagaaagagactatccaaataagcaaaatcagaaacaacactaatgatattacaactgatcccacagaaatacaaaagaacctcagagactactatgaacaactctaggcacacaaattagaaaatctaaaggaaatggataaattcctggaagcatacaatctccaaagatggaatcatgaagaaattgaaactctgaatagaccaattttaacttctgaaattgaatcaataataaagaacctaccaagcaaaaaaagccctggaccaagtgaattcacaccccaattctaccagacatacaaacaagaactgatactaatcctactgaagctattccaaaaaactgaggagcaggggctcctccctaacttattctataagacaagcatcagcctgataccaaaatcaggcagagatacaacaacaacaacaaacttcagactaatatccctcataaacacagatgcaaaaatcctcaacaaatattagcaaattgaatctagcagcacatcaaaaagttaatacaccacaatcaagtaggctttattcttgggattcaatactgaaatcacatttgttgtgatttgtgatttgctgtgttgcaagattgcaaatacttgcatatgttgcaaatcatatttgcgtttgttgcacatgttgcaaatcaacaaacatgattcaccacacaaacagaatcaagagcaaaaactataggatcatctcaatagatgcagagaaaccttttgataaaattcaacattccttcattataaaaatcctcaataaacaaaggaacatacctcaaaataataaaagccatccaggcaaacccacagccaacatcagactgaatgggcaaatgatggaaatatttcccttgagaactagaacaagacaaggctgcctactctcaccacttctcttcaacatagtactggaagtccttgccagatcaaccaggcaagagaaagaaataaaaggaatttgaaaaagaaaagaagaagtcaaactcttttcactgacgatatgattttgtacctagaaaaccctaaagactgctaaaaggttccaagaattaataagcaactttagcaaagtttcaggataaaatcaatgtacaaaaatcagtatcatttctatacaccagcaacatccaggctgagagtaaaatctagaacacaattccacttacaatagccacaaataaaatgaagtatctaggaatacagctaaccaggaggtgaaagatctctataaggagaacaacaaaacattggtgaaagaaatcagtgataatgcaaataaatggacaaacattccatactcatgaattgaaagaatcaatattgttaaaatgaccatactgcctaaagcaatttacagttactgctattcctgtcaaactactaatgtcactgtttacagaattagaaaacactattttaaaattcatatagaacgacaaaagagtgtgaatagccaaaacaatactaagcaaaaggaaaaaagacagagacattacactacccaacatgaaactgtactacaaggatatggtaatcaaaacagcatggtattggtacaaaaatagaaacatagaccaattgaacaggttagagaacccagaaataaagccacacacctacaactatctgatatttaacaaggctgacaaaaataagcaatggggaaaggactccctattcaataaatggtgctgggataactggctagccatatgcagaagactgaagctgggcccatactttttaccatatacaagaatgaactcaaaatggattaaacatttaaatgtaaatcctcaaactataaaaatcctagaagaaaacccaggaaatagtcttctcaacattggccttggcaaagaatttatggctaagtccccaaatgcaactgcaataaaaacaaaaatatagtgagaactaattaaactaaagagcttctgcatggcaaaaaaaactatgaacagagcaaagagacaacctatagaatgatacaagatatttgcaaacaaggcatccaacaaagcctaatatccagaatctatggtaaaaaataaataacaagcagaaaataaccccattaaaaagtggacaaatgaccaggcgtggtggctcacgcctgtaatcccagcacctttgggaggccgaggagggtggttcacgaggtcaggagatcgagaccatcctggctaacacagtgaaaccctgtctctactaaaaatacaaaaaattagccgggcgtggtggcgggcgcctgtagtcccagctacttgggagactgaggcaggagaatggcgtgaacccggggggcggagcttgcagtgagccgagatcgcgccactgcactccagcctgggcgacagagagagactctgtctcaaaaaaaaaaaaaaaaaaaaaaaacaagtggacaaaggacatgaacagacacttctcaaaagaagataagtggccagtaaacatatgaaaaaatactccacatcactatcagagaaatgcaagtcaaaaccacaatgaaattctacctcacaccagtcaggatggctattattaaagagccaaaaaaacaacagatgcagaggctgcagagaaaaggaaatgcttatactctgctggtgggaatgtaattagtacggccactgtggaaagcagtcgggagatttctcaaataatttaaaacatagctaccattagacccagcaatcccactactgggtatatatgcaaaagaaaataaatcattctaccaaaaagacacatgtacttgtacattcatcactgtgctagtcacaatagcaaagacatagaatcaacccaggtgcccatcaatggtagattggataaagaaaaaatagtacatatacaccatggaatactgtgtagccataaaaaaaaatgaaaatgtgacttttgcagcaacatggatggagcccttggaggtcataatcctaagcaaattaatggaggaacatataaccaaataccacgtttgcacttataagtgggagctaagccttgtgcacacatggacatcagtatgggaaaaatagacattgtggactccaagagggtggaaggcaggggatattgggttaaaaatctacctaccaggtactaggctcactacaacagtggacgggatctataccccaaacctcggcatcatgcaatattcccatgtaacaaatctgcacatgtaccccctgtatctacaagttgaaattaaataataacaataataaaaagtaaaagtgcctggggtgggggaaggtattatcaaggtgtaagttttcagagtggatctaccctaaaagtccttatagaaagccggtttattttattcaataaaacaaaagaaaggaaataactctaagacaaaagatagggttgtcacatgttgtaaatataatcttcattcatatacaaatccaattaaatttaaatccaatttaaattggtttaaatccaatttaaattggattaaatccagtttggattgggttaaatccaatttcgaacccatccactgtataaatatgaggaaaatatgttaaattttttatatttatatctctccatttaaattcttacatattgtgaataaaatcaaattttattgacatattggcgaagcataattcaatattaaagcatatgtccacacaaaacttttacacaatgttcatagcaacatttttcataagagcccaaaagtggaaacaacccaaatgtccatcaactggtaaatggataagcagcatggagcagaatatccatacaaagaagtattacttggcaataagaaagaatgaagtactgatacatgctacaacatggataaaccttagaagaattatgccctcacattctccaccatagtgcaacctttgttcatcaaagaaaaatgaaataacgtcttttattcctttattattttggaaagcaagagaaagttattaacagtaacatgacaataaatatcatatggaaaagtttcaaactgaccaattcaccttgcacattgttcattcaaatgtaaattagtgcaactattataagaaatagtatgaagttttctcaaaatcgtaaaaatagaactacaatatgatccagaaatcccatttctgggtacatataactttttgtcaaagagatctgcattctgatgtttattgtggccttattcacaacagccaagataagaaatcaacctgtatctatcaacacataaataaatggataaagaaacaggggtatacacacacaattgaatactatttcactgtaaaaaaaaaaaaagacaatattgtcatttgcaacaacatgggtgaacttcaagcatattatgttaagtgatatgtcaggcacagtaagagaaataccacatgatctgacatatgtagaatctaaaaaaagttgaactcacacaagtagagagtagaatgctagttaccagggtcaggggcattattggttaaagaatagaaaatttcaattagatggaaggaataagttcaagaaatctattgtaaaacatgtagtagaaaatccgtgcaaggaagtattacaacagaataacaacgtattgtatttttggaagttgttaagagaataaatcgtaagtgttctcaccacaaaaaaaatgataaatatatgaggtaatgaatatattgattagctcaattgaactatttcacaatgtgtacatattttaaaatatcattcacatgataaatatacataatgtttatttgtcaattaaaataaattttgtttacaaaagaaaaaacagtatgcatatttatatttttcaggattcttgttacattgactttgtttccaatagtaattgtgaggttcttcatgaactgtgcccatgggctccagtgattggtaaattattccacctctaccatggtgactgaattaaacaagatcctcaggtggttcatgtgtacattaaaatctgagaaacacttaaaaaacaaaaaatggaacaatgaagacatttaataaaataaatcttaaacaaattatataattagataggacaatacaataacatgcattatccttgtcttaaaaccaaaaggatattttttcttccaattttcttatttttaaatttatttttaatttcaacttttattttagatacagggggttcatgtgcagatttgttatgtgggaatattgcatgatgttgaggtttggagcatggacctcgtcaccctggtagtgagcatagtgcctgataggtagctttttaacccacccagcccacttcaccctctagtaatctatacagtgttgattgtttttttccaattttctacatatgcctctagagtaattctgtcatcaattacaaataaattaaagcgctttctcatatctctgaaggatgtaaatgaatattagcaaaacagttggtcttcagaaatttagaaactaatgtaatttgaatctttcccttgccagggaacatacatgccaatctagatactcaagagctatgattaaaatttattcttttgtaaaaacaccagtacagtagctatattcacataatcccttttcttaaattagtcacatatctgatgcactagtgttcttccagagttaaacaggatttttttttttttgacagtctcgctctgtcgcccaggctggagtgcagtggcacgatcttggctcactgcaacctccacctcccaagttcaagggattctcccacttcagccacctgagtagctgggactataggtgcccaccaccatgcccagctaatttttgtatttttaatagagacggggtttcaccatattggcaggctggtctcgaactcctgactttgtgatccgcctgcctcagcctcccaaagtgctaaacaggacattttaaaagccaacatcagctaataagctaacagcattttatttttactaatgaaaaaaacatttaaatctatctgtgtagttttttatttcaatcctctaaaacaaaatcaagaactaacaaatggttaagtgaattatgcatgatagtatgattttttattataattaaaatgctctttttcaatatttctaaattataaataattttaacatatagtacaaaaactttgcagcaataagtcagcataactggtaactgaataaagacaatttattatgatcctggactcacaagacagattctctgggttcaaatcccagctctgccttttccagctgcatgacattggagagtactttaacctctctgaaccacatctgaaactaggaagaatattagtacctacatcagagggattttaggagggttcaatgggctaatacatgtaacacacttacggtgtttcctggcacataatcagtactacatgagttagctcacattattatatttattttatttattttctcagagcacagagtattatctttattttccttattactattatcctttcttattttattgttattatcttcagttatatttcatgagcaaagtagtattatctttatttattttcttagagcacaaagtattgttatacgatattaaaccaaattgtaaaatagttgtttcttattattgatattaatacgtataaagttcaggggttaatgagtctcagttgaagtaaagagtgtcttttatcaaacttaatagttttgttgttgttgttctaaagaaaataattcaaatttacttataataaaataatgagtatgccacagacacaaggtacatgttaaaggcctcttctttataatgaaataacatcaccttcatcttatcattttagaacatcatcagacatctccacttcactaaagtctagggaacaggaaaggaagaagttgaattctcctcatttatctgaatcaaaagacatcaataaaatctatggagcatgcctcctagattgacaaagacatggtctttcactaaaaccaaagtgaaagaactaaagaatttgaaatatgtctgctactttgcaggttgcaggatgtgagaaatgtctgtataaaatagaaaatatccatcatggattcagctgtggagattttccttatgattataattccatggataactcacaaagttaatttcttactacaacccagtatttcagggtgtttttgttgttattttttgtttttgttttgtagaccaaactgcatctgctctaacatcctcatagattgtatgtacaagtaaacatgtctcaggtagaataacacatcagcttcagaagactacccacaagggcacctttcccattgtcacatggggaccatgaacacctctctacacatcatgggctttgggtttttaggtacattaagcactcaatttacacaacccttctttgggtttcttgaacaataaatctgaataatgatttcttcttagatttcttacaaattttaataaattatgttttttcatcacgaaatgaaagaagctaatcagattaataagacttttctgatacagatattttcttctactctttctgaattctccagaatgactgataaggtattctgcatgttatataaacttaaaaaaaatactgatataaacaaacaaatggactagtattggtggcattagaataaactcattgttttgaaaatatatacatagaaatatagatgtatgtatatgtatgtgtgtataatatcactaatattgggacaaccaacatcatgctcacactgaggacacaatatcgctttgtgctattgttatcaaaaatgcatagtctgaatttaatcatgaaaacatcagacaaactaaaaacacaaacacaagacaaactgagaaaatcttccacattaaatgaaactaagggaaaaaaattcagtacaatgcatgaccctggaatggatcctggactgtgaaaaataaatagacataatctggggacaactgacaaaatttgaatatgtgtggactctaaactagataatattatatcaatgttaaatttcctgattttgataactgtattgagattattcaacacagtgtccttgttcttagaaaatatacaataacgtatgtaagggtaaaggggcagggtgtctccaacttactctcaaaaagtccagaaggaagagagagagaatgagaaaggaaatgatatacattgtaaacaattaatgaatctgagtaaaatgtgtatgggtaaacaagagcttcttgtactatttctccaacttttttgtaattttaagttaaactgaaatgaagttaccccagatatagcttagatttgtctccccactcaaatctcatgtcaaattagaggaggggcctggtgggaggtgattggatcatgggggtggatttcccccttgctgttctcatgatagtgagtgagttctcactagaactgatggctaaacatgtgggcacattctcattcactctctctttctcctgctccaccatggtaagatgtgcttgcttcctcttcaccttttgccattactgtacgtttcctgaggcctcccagccatgcttcctgtacagcctgtggaactgtgagtccattcaacctcttttcttcataagttacccagtctcaggtagttctttctaggagtgtgagaacaaactaatacactcccccaaaatattaatctgtcaaaaggaatagaggaatgttctttctaaaaggcctagtaattaaacaaacaagaaaaggttgatcttttaaatagaggtgatttccaatatactcttagattttatgctctttggtaaatttattatgcaaagtgatatgaaagcctagatttatttgaatatattaaggaattttctttaaataagccacccaaacaattaggctttgcatatatttgtggtagacatccgttgttttacctgctagcatctcttagtccttcttcaggaaacagcacctctctcctccctccccaacccccagttagcactctgccctttcatcacttcatatgactataaatgctgtcaatattttcactttatctttctctcctaggagtagcacacaacctcaattgaccaaccagaacatcttgtcccaagattttacatgacccaggcagagccaataagaatgtttagagatattgacatagaagaaagagggtaattatcagctaataaaaagaaccatggaagcctaaggtttcaaggaactcgctttgctacctcatagagaagtcagcctgagaacagagccaactcagaggaaaacaacagctactttgggttgttttccgaagacaaagatttatctaattcaaaaagatagacactaaacacttttcagttttaaatcaaattcaaaatgagaactagaatattcattttattttcttattgcaaccttctccccaccaaacataccacaaaaagaaatgaatcaacaacacaatagtaatacatgagacaaagttaacattattgatgattgataatggagtgtattattctctcagattcatagaacagggccccacctatacaggcagtgccaagaaaaggacttggcacatagtgtgctcaatcaatgtttgctgaataaatgaaggtcggggactcttcaatctttacaagttactattgttatcaaaaacgaaagtgcctcaaaataataactgatagagaatgagcatatcatcttcccttagaaatatattctaaatttcaaacatagctctttctggatcttcttattatgaaagcataaatgctgttctagtcaggaaaaagaatcaataaatactcaaaaaattaccaggacctacaaaatgtgggtcaaatgtcaattaacacagtcagccctaatgagctgttctgttaccatctctcaccttcacccattatctgtaggtgtgcgactgatgaggatgtttaaatgaacagataaaggggtccctgcttctatacatttcatattactgttgacatttatcaccaagctttcaaccccaactgtctttgacaatagattttaaaagataataaaattcttcaacaggctttcaattcaatcctcttgtcattgtaacaaaacagcactaaaaatgaaacgaaagccagatatgacagaaactgctgaggagctaaggatgtatgatcattctttttaatgttgatatttacatatgagtttttgcttttcctaccaaaccataaataaaaatttcaatagaaaataaataagttaattcattcttcttatcaatatggtttctatagcatttcatttattaatacctttaaagataactgaaggattctgattatataacatttgctaaggcttcaaggtaccctagataaattttccaaaaactttcttttttatattttgaggcaaacaatttctaactactatttctttccaaaacagaaaaaatagaatcatcattatactcaataattttcttcctagcacttaactctctaaacaattatttctatatttatttgtctaattatgctcatcgactaaattgtaagttccatgaacagagattgtgtttgatgatgttgtcaatctttgttacccaagcatcaaacctggtccatagttggtgctcaatcaatgtttgttaaatgaatacataggtctgctaactttcccacttcttttgaaaatactcaaaaaacatttaatttaatccaaattcattcagtccctaatactatttttaaaaagcgtgtattagaaatgttttcggaattaactgggggcttagacatcagtgtgtcactcaaagcacttagtataatgcttcaaaagtactccctaaatgttaaattgaaataaattacatgtaataaaagttactttgcttctacctgtgaaatataagaaaaatttaacaacatagcaaaactaaaagatgtcttaattaacttatttttgctcattttgtggtgtctttcattcattcaatatttattgaaggcttatactcagccatgtaggtgctagacatacccaaatggatgagatatagtttagtgaaggagacaggtgaacaaacaacaatggtataatatgaaacctctgtaatagaagtatacacaaaagagctgctggagcacaatgcagcagagaggcactctcaatgacaggaaggaagaaagtttcaaaaagagatgggtgatcaggcagaaaataggaaattattaattccatacaaagaatatagtacattcttggttctgcagaactggaatgctttttctcttcatctgttttttgaagaggaaaaaaaaaccgtgcagaagcagggtatagccactaggaatttacttttcctttatttgctatcaaatatggtggcaagcaatatccatatattagctgctttgcctcagcccgccatctgaaggtagggttcttcaagtgcccaaatggtgcaaaatctcgaagctgatatcactcactccataatgagatgaatcacagaggggtcttttgctactcacagctgggccactgtggccatgcatcaccactcatagagaagggggatggagagaggtgttatgaccgtttttgttgctttttgtggagtgaaaattatcagcctatggtgttttccaaccacaacattcttacctcatatactcctccatgctgcagagagacatcctgtttctgggaagggccttgaagactagagaccttggcttatttgagaactagggtcaccctctgtttattgcatagccctatggggtgtcacaggtcctaaggaagagactttccttaaaggtcataaagcataaaacacacacgagtgttccagcgcatgaaatgttcagagatcagcaagaattcccaaatgggtagaaaaaacatagaacaaatgagtagaagaagcagaaaatgaccttgaactaacatatgaagagatttatattctaggataatgaaattattatgactttatcctcctagcaatgtggaaccaacaacacttttgaagcaaagaaatggagcaaacaaatatgtctggctgataactatggtggtagcaagaaagatggattgaaagagaacctaaaagcaaaggggaaaactatttctgatttccaagtgcaacttattaacagttcctcatgaactgtagataggaaatacacaaaattaaagcaaatgatgctgtttgtaataatagtaagttgtaatagaagaaagagtagaaagttggtaaaggatgagttcatgtcctttgcagggacatggatgaagctggaaatcatcattctgagcaaactatcacaaggacagaaaaccaaacaccgcatgttctcactcacagatgggaattgaacaatgagaacacttggacacagagcagggaatatcacacaccggggcctgtcgggaggtgggagcctgggggagggatagcattaggagaaatacctaatgtaaatgacgagttgatgggtgcagcaaaccaacatggcacatgtatacctatgtaacaaacctgcatgttgtgcacatgtaccctagaacttaaagtataattaaaaaaaaaaaagaaagttgttaagtagtagcaacttgcaaggaaatcttgaaataaagatgcaatttaaatagctaactacttagtgcatttatgatacatgctgaaaattttcaatgtacaggaagaaacagtattttttccagattcagtcatcaagagacagttaacttaattttgaagatgagttttcatttcttattatttaacttagtgcgtggtaattaatttttaatttataaatgaacagaaaccagatggtttcacttgatggctttaacaaaattactgtatgtcattaatgattctatctgattctttatgggtaccaggcatcttttgggggatgtttaaaagatctaccaattttgcttctataaaaggctaaataaaggaggggtgactgggcacacagtatggctagtttctccaacagtcctcactcccaagagtgaggagatctgcttcatatacaactgtcctagaaaatccactctgagtcaaagccccaaataagttcctatattcctggagaatcttcctggagggagatatgccaggggaagggagtactaaaaagtgtaatgttgtgattagatatgtcatattgtttgatatcattaaatagcaattagatattcttgccttaaacaaaattatgtcatgttttggccccttctctttgtaaaaattcaaaaaactcatattactgccgagaaagctcactgccttctcgagattatttttcctctcaacttaaactgtggatgtagatacttttctcatacgtattatgtgtatatgaatatatataattcttatataaagtaaactaagatccaaaatatttaactctgttaagtgcaaagtctcatttttataaatcaataaaatgaccagggcaaaaaactagacagtgagctgggggtctgaggattcagatccattcccagctgagctttgacaccacctgttgaaggctgtcctcaccagagttcagtatgcatggggatgattctgggcccagaagatgggtggacttgcagaaaataatgatgcttacagaagacctcccagttggttagctctagttctgttagttcaatagagggagacagcttagtgaacagtgaggtctcaaggtccacctttcatctccctgcttctagagaaaaaattttcccatgaaaagtcttcttccccctcaggtctcccatagaaattcagtccactcttttgagaacaagggttaagaggaaaataggacccaattttaaattatattatatccaagtaagaattcaaaacaattaacataaacattcatgaacagccttcatatggatataagatattgaatatcccttgacttgacagtacatatgtagtagttcagaaataacaattggcatcctaggtaagtatgatgaattaaatgctcttatcaaattccatagtttacctttataattttggagtaattttagtatttacaacatttttctactataataatatacaataaaaggaaattatttatatatcattaatgagttgaagacacgtaaatgaacaaatcattttaaaatgggccttagtaatagaattagagagatgtaaattaattaagaaaatactttaataggtttttccaggaacacaactagaataattgtagttgtaaagggaaatattagcattataacatagcttaataaatggacaaatacctggggagatgagttaattactaaagtagtttcattccaaacataagtgactgtgatggttaacactgagtgtcaacttcattggattgagggatacagattattaatcctggatttgtctgtgtgggtgttgccaaaagagattaacatttgagtcactgggctggggaaggcagatccacctttaatctggtgggcacaatctaatcagcttccaatgaatataaagcaggcagaaaaatgtgaaaaggggagagatggggctagcctaccagcctacatatttctcccttgctggatgcttcctgcccttgaacatcggactccaagttcttcagtattagaactcagactggctctccttgctcctcagcttgcagacaggaccttgtgatcatgtaagttaatacttaataaatgcccatttatatatatcctattagttctgtccctctaagagaaccctaatacactaatacagtgacactttctttactcctgcaaacctcaaataatatacttcttccagaacttgattatgatgtttgtttttatccttacttggatatggcaatcacacattaactctacgaattagtttttgatttgtgtttgtctagtattaagttacttactagaactttggcccctccttacaaataaaagccctaaaattatcaaaatcaacccttcaaacttttctcaaatgctttcattaaaatagattaagaataaaatgatttagtttgcatccatatttctcccatattcttatatattttacatcttttttataaaaggcaaagagcctgaatagaaataacaaattacaatttgactataatagtggtggtgcaatgctatcaatgaataagtgtataaagacccagagttctgttttcttaataattttgaggacaattagaagagattaatgattccccaaagcaagaaatacaggcatttatttgtgttgtatatagttagctaaatagaactcattattagctagtagaactcagcaacattccaaaatagtctgatcattatttatttccatttgtatttgctagaaacagagaaacaaaaggcaacatcaagaaaaagtataaaaacatccaaatcccttatttttgcctgatcaattgtgtaggtttttttctacatgtcgaggcctttttgataaagcaaattgtctatcagagcccaatccagcatctctccactccaaactggtaaggcaattatctagaagactattctcctgagaaaaccaattataaatgttctctcaaagtaagtaagcataccaatttggatgcacatgtttttttggttagcacttaaaagagaaacaaaaaaagtgtgctgagaaaaaaagatctctgtctctctcactcgacacaaaccaaagaatcatcaattgagggaattaccaagaattaactgataaaggaaaaagacttccattgatagttctccataaaatttatttttggtgagaagagtatattactttctcttggtttgctctgccaaatctcttgtccaaatcctttatatttcattttcaagcaatgctacttggctcccacctctatagtcctcctactcttaaacattccaaatatgaccaaaaatacaatgttctttatctgttgctttagccacggaagtaaacaattcacaattacccaattcagctcaaggagcacagttggttcctagaaaagtgctagattagaaatctaaagacctggactgtagtcttggatataaatttaccagctgtgtaatcaaggcagtatcacttcaactcccctagtgtccattttcacatatgttaatggtggaggttgaattggactagatgtcctctaaaatctcttcccattaaaagaagtatgggatcttattattgtgattaggaacttctactccaaagggcaattttatatttaatagtagaaggaaatgatatatttaatagtacccagaatttttttttactttcctaatacaagggagatggaaggagataataggaaaatggttatgatcccctccttcatgtatactcaggtccaggtcattcatttattcaaaaatagttattaaaacttggtatgtgctagacatatcaagcattagacaacagtaaacaggtgtgaaacatcctttaatgcagcttagggtctaatgaaagattaaaatactgtatatgcaattatgggctggaaaaaatggtcctcttttaatgaatgagcatgactcaaacataactacacacacacacacacacacacacacacacacaccctcacacatttcgcctaaaaagaaaactgttctccaagtgggcaagaaaatcaccttttgtccccagcctaaagatattatctttagcaaagataaataaatttgtcattcttgctaaattcctctgagtttgtttataattgaaacttcagatagctccttaagttaacaaaatgggtaaatggcattaagcatgaatttgaccattaagggaaggctattgtcctgttgctcctgcctatcatctttctcaaactgtcataggtattttcacctttggatatcagttgaagtcaaccactaatggactatattaatttttcttctgatgtcagcaactgaaggaacaagtacatcccatgcctgaaatggaaaaggatggtggttatcagtgcagctttattccctaggaactctaaacttgtcttggaaaacaattccctttgcagttttcagggtctttgaccgcagacttaacatatctcagaatcagagtatctgctcatgaactacctttactggttgtttcaggtactcttctaaatgctttaagaatagggacttatttagtccttctaacaaaccccatgagatagatacctatgttatcctaattttacagatgagcaagcagttctcacagcttgtatggcagaaatagaattcaatccaggtagtctggccccatgtagatacttttaactatgtagatacgggtacaaaatgcagcaaatgacaagaagatgcagcctgaagggtacactgagaatatgaaataacccaaaatggactctggggtaacatgtacagcattcttattatattaaatacccattaaaccaagatgaacaaatctcctcttgtttaagagacacagggttagaagtgttaatttttttaaggaatataaataagattgaaaatgaacccacatggcttaaaatgaaattaatcaaacaggagcctttccaaaaatggaagcactatctcatagggactttaatcccataattcaaaatggaatatcattccccaaaacatgtttctcctccagtgttcgtattccagttatggcaccactactctcttaattagaaacctgggaaccatctgaactccaccttctcctccaacccacatattcaacctataataacttagattcaaaaaatgaaattaaaaatattttgaactgaataaaaatgaaacagcatttcaaacttgcaggatgcaactaatgcagtgtataaaggaaaatttatatcgctaaatgcctatattagaaaattaaaatggtctggaaccaattaactaagctcccacctttaaaactagaaaaaaatcaagttaaagccaaaataaaccaataagaaagaaataataaagataaaattagaaattaataaaacagaaaatgtacacttacattaaaaatttcatatatgtttctgctaaaaaactttagtacctatgtttctattagtttcctgaggctgcttaaacaaattgctacaacctttgtagcttaaaacaacgtaaatttattctctcacagttttagaggccatgaatccaaaatcaaggtgtcaacaaggctgcacaccctatagagagatgctgtaagagagaatctcttctttgccttttccagctcctggtggttccaggtgttccctggcctgtggtgctatcactccggtctttgcttctgtcttcacatcactttctcctctatgtgcctgtgccaaaactctctctgcctttttcatataaaatacatatgattgcatttagatcccaaccagatcatccaggataacctcatcctcatgagatccttataatgtgatcacatcatttaccatataaagtaacattcactcttttgccatataaggtactattcacagattctgaggattaggacatgaatttatctttttgggggtcaccattcagcccatgacaacgatcatgagagatatagtttttctttcttgcaatgtttctgtctgattttggcatcagggtgatgctgactttatagactgatttggggagttttttctacaatttttctagaagagtatgtgtagcacttgtattattttttaaatatttgatagaatgcatttttaatttccttcatgaacttttcctttgccttcacaacttggctgtttggcacaagaggcccagctttcagcctgtcttagattttgacataccttcctcactgaacttaactatttttagctttttacttaaagtgagagacatgcaactcttcctttcatttgaacactttgaggcaactgtagggttattaattgacctaatttcaatgattttgtacttcaggtaatagggaggcccaaggagagagacacagatggggaaaggctggttagtagagcagtcagaacacatacagcatttgttaagttcaccatctcaaatgggcttggtttttggtccccaaaacaattacagtagtaacatcaatgagcactgatcacaaatcaccataaaaatgtaataataatgaaaaattttgaaatattgcaagaattaccaaaatgtgacacagacaggaagtgaccacacgctgttgggaaaatggagctgatacacttgctcaatacagagttgccacaaaccttctatctgtaaaaaatgcagtaactgcaaagtgcaataaagtaaagcacaataaaacgaggtatgcctgtgtttctttgtattgcctttatcaaacacattgaacatttacagtaagaattcaatgtattgaatgtatcaaattaatatgtatgaaaatatgtattggatgaatatatcatgaaaatgtattgaataaataaaatgaatgaataaatgaacaagtgaataaacaagtgaaagttcctgtccgtgccatcatcatatattccttagacaccacttcgcacaatagctttaagtggacaaatatgaatcaaccctagccataccacctctctaaaaatgaagtgttcaaaaaattattttcctgaagtttataatcctacatctactaagtactaggcagtcagaactgcctggatttcttgaacttccctctccaacacaccctttctcacctctgagatttctatctagcctgggtacaatctcctcaatacacttttataattttgacatttcagtgacattttcatttgaaccacatattagtctttcttgtctcctctattaatctgaaactccttcaagacaggcttttgactattttttaatatattcctaaaacctaaaagaacaaaagagccacagctttggaatgagtcagaccttaatttgaatcctaagtgtttctgttaacttgcaagctgagtagccttgggtaagttacctcaactctccatctcaatgtcctcatttgaagttggcaataatagtatctatcttgtaaggttgtcattagtactaaataggataaggtccataagcccctatcacagtttctagaatactaataatgccatcaatagtacttaaagtatgggtgcttaatgaacactacaattatttttcctttaggaaaacagaaagcttcacaaggtacacattttaacagtgtcgagattaaatctatttaaatccagaaagcatcccctattatttgctgaatggcatttactgactataaaaactcaggcggtgctatatatccatatatgtgtgtgtctgtgtgtatatgtttaagcccattgtaataaagaaattgctcaattagactcaaagaattgcctaaaatatgtactgccagcagctcaactatattcacaccaaaacccaagcgacatcatggaaatttaaagctgaaacctataaggaatcctaaaaagcacctgattcgcttcttcatttttctgataaggaacctgagtttgatgaaagtcatgacttaccaagtcagcatagtgagtacataggagagccttgttgctgcctcccagatttgaaagtattactgtttcatatctaaacccacattccctctatcttcaatcacctgagtacctgtgaaatcagaaagtaaccttagcaataataaaggagtagatgtatatacaggtagcctccgaagcagtgtgatgttatgcctattgttccgatatattgctataggaatctgctccatgttctacaatttacaaataaagcatttctttttgttatgtattcaaatgttcctagctttttctttctctcattgccttttatttgtaactagtgctcagacataaaggtttctttttctattaagttttaagcccaatttcaacagtaatttcaagtgtaattactgctcctttctggcaacagctctgaagtaaacccacattcatactgttcagcaacatagacaaactcaaacatccatacatccgctttcacattttactcttaaagactgaatttgaacataccttaatgtaataaaagccatctgtgacaaacccacagccaatataacattgaataaggaaaagttgaaagcattctctctgagaaagggaataggcccactctcactgctcctcttcaacatagtactggaagtcctagcgagagcaatcagacaagagaaaaaaaatgaagggaatccacatcaataaagaggaagtcaaactgtcactgtttgctgacaatatgatcgtttaccttgaaaaccctgaagattcctccagaaagctcctagaactgatacaagaattcagcagtttctggatacaagattaatgtacaccaatcagtagctcttctatatactaacagcaactaagcagataatcaaatcaagaactcaatctcttttacaatagctgccaaaaaaataaaatacttaggaatatacctaacaaagcagtcgaaagacctatacaaggaaaactacaaaacactgctgaaagaaatcacacacaacacaaacaaatggaaaaacatcccatgatcatggaggggtagaatcaatactgtgaaaatgaccatactgccaaagacaatctacaaattcaatgcaatccctatcaaaataccaccatcattcttcacagagttagaaaaaacaattctaaaattcatatggaaccaaaaaagagcctgcatagccaaagcaagagaaagcaaaaagaacaaatctggacacatcacactacctgatttcaaactatactataaggccatagtcaccaaaacagcatggtactggtataaaaatagacacatagactaatggaacagaatagagaacccagaaataaacccaaatacttacagccaactgatcttcaacaaagcaaacaaaaacatgaagtgaggagaggacacccttttcaacaaatggtgctgggataattggctagacacaagtaggataatgaaactggatcctaatctctcaccttataaaaaatcaactcaagatggattaaggacttacacctaagacctgaaactattaaaattctagaagataacattagaaaacccttctagacattggcttaggcaaggatttcattaccaagaacccaaaagcaaatgcaataaaaacaaagataaatagctgggacctaatcagactaaagagcttctgcacagcaaaaggaacagtcagcagagtaaacaaacaaaccacagagtgggagaaaatcttcacaatctatacatctgacaaaggactaatatccagaacctacaatgaattcaaacaaatcaataagaaaaaaataaacaatcccatcaaaaaatgggctaaagacatgaaaagacaattctcaaaagaagatacacagatggccaacaaacatatgaaaaaatgctcaacataactaattatcagggaaatgcaaatcaaaaccacaaggcaataccatcttactcctgcaagaatggccataagcaaaaaatcaaaaaacagtagatgttggcatggatgcggtgatcagggaacacttctacactgctggtggaaatgtaaactagtacagccactatggaagacagtatggagatttcttaaagaactgaaagtagagctaccatttgatccagcaatcccactaatgtgtatctacccagaggaaaagaagtcattattcgaaaagatacttgcacatgcatgtttacagcagcacaattcacaactgcaaaatcgtggaaccaatgcaaatgcccatcaatcaatgagtggataaagaaactgcagtaaatacatagatggaatactatgcagctataaaaaggaataaattaacagcatttgcagcgacctggatgagattggagactattattctaagtgaagtaactcagggatggaaaaccaaacatcatatgttctcactgatatgtgggaggtaagcaataaggacccaaaggcataagaatgatacaatggactttggggacctgagaggaagactgggagtggggtgagggataaaatactacaaatatggtgcagtgtatactgcttgggtgatgggtgcaccaaaatctcacaaatcaccactaaagaacttactcatgtaaccaaataccatctgtaccccaataaatttaataaataccccaataaatttaataaataccccaataaatttaataaaatttaaaaatataaaaattacacaaaaaaacaactaattttagaaatgatctaatcatgtaggaactacaacctatgtaactggccatttgagttgtaatataaattagtaaaaatttttcactttgtctttcttttatcaatttcttagtaagaaaaaaagaaatagaacttaaatattcttagatatttttaaggttgatgtggtaattagttttataacttttttctggaatgaaatgaaaataggaaaaaagagctgttttagctaactttctgactgggtataaaaatggtaaaataagcctataattactttttctggagaaatatgaaataaaagatttaaatttgctaaagaaaaatactgaatttgaaagggcaacaaataatggcttggaggaaaataaattaagataaaataattataaaaatggtagaattttggtataaaaatggtagaataagcttataattactttttctggagaaatatgaaataaaagatttaaacttgctaaaaaaaaagaaaaagactgcatttgaaagagcaacaaataatggcttggaggaaaataaataaattaagaggaaagggtcagggagcactaccgactcacagccaagttgtttttcccacttactggcataagcagtacttggcagtttgggcatgatgggaatgttcccaccacccctcctaaaagaagaaaaattgtatgtcaacatacaagaggcaaggctgccaaaactatcaataaagtataaatttcatgagggtagaaatttttgagagtttcattcactgctgaaatctctcaggacagtatctgacacacagcaggctctctctaaacatctgctccgtgaaggcagtacatagaccttattggcctcagcatcagatcctgacagtgaaactccttacaacaccactagcatctaaaattaaatattcaagggaggagcaagatggccaaatagaagccaccatcaattgtccctaaagccggaataccaaattttaacaactaactacacacaaaaaagcactgacataagaacaaaaaatcaggtaagcaatcacagcacctggttttaacttcatattgctgaaagaagcactgaagagggtatgaaagacagctttgaattgctggtgccacccctccccaatctccaggcagtgaccatctggcacagagagagaatctgtgcacaagggggtggaagagcacagtggctggggcacttgctgccttgaaggaagattgaacttatgccctgtcacagcagagagcaaagccatgctgggcttagccagctcctgcccaaaaagggaacatttggacaagccctagccagagggaaatcgcccatcccagtggtcagaacttgagtttcttgacaaacatcaccactgcgggccagagagctctggggtccttggtaagctttaaaggcagtctatgacacaaggactgaaattcctcctactgctgagcttagagccagtggactagggtggcacatgacctagggacagagtgaaaaacggggtgttttttctactcctcccacaagcccaggcagccctgctcgcagaaatgaaagtgactctttccttctgcttgaggagaggaaagcaaatagcaaagaggactttgccttgcatctagaataccagctcacccacaacaggatagggcatcaggcagagtcctgaggccctgtattagcctgttcttgcattgtgataaagaaatacctgaggctgaaaattttataaagaaaagaggtttaattggctcatggttctgccaatcagcatcaggaaacatgatgctggcatctgttcagctcataaggaggtctcaggaaacttacaatcaatggcaaaaggcaaaggggaagcaagcacatcttacatggccggagcaagagcaagagagagagggggaaggtgctacacacttttaaacaaccagacctcatgagaactcactcactatcgtgacaacagcaccaagggggatggtgttaaaccataagaaactgtcctcataatccaatcacctcccactaggccccccacctccaacaataaggattacaattaaacatgacatttaaatagggacagagaaccaaaccatatcagacccccattccagtccgtagctcctgggcaacatttctcaacacaccctgggaacctgcccagaagggagcctgctaccttgaagggaaagaccaagtcctggcaggattcatcatctgactaaggagcccttcggccccgaacaaccaaaggcaatatccaggtaatatgccatgggccttgggtgaaactctgagacatgctggctttaggggagatgcagaatattcccagctgtgggaactatggtgaaaaattctttctgcctgagaaaagcatggggaaacgtaaagggggctttttcttgcacattaggtaccaactcagccacagtgaggtagagtatcaagctgactcttggggtccttgagtccagacctaggttcttaaacagaatttctggacttaccctgggccagaagggagcccacatcccttaagggtgacttccaggcctggcagcgttcaccacaagctgactgaagagccctttggctttaagtgaacatcagcagtggcctggaagtaactcttgtcacctgtggtggtggtggtggcgatggaaagagacagctccgcctgtggaaagtggagggaagagtgggaaggactttgtcttgtggtttgagggcaagctcagatgcagtaaaacagaacacaaggcagatttctaaggtttttttactagaatccctggctcctagacagcatctctgaacctactcaagacccaggagaactttccactctgaagggaaggacataaacctagctggcttccgaacctactgattgtagaaccctagaatgagctagtcagtagccagttagtggttacagtaagcctttggtgagacccagtgctgtcctggcttcaggtctgacctctgtagtcccagtattggtggccacaggggggattgtgttaccccatccccagatgcaggcagctcagcacagagagagaaggtccatttgtttgagagaaagtaagagaagagaacaagagtctctgcctagtaatccagaaaattattctagattctatacaagaccaccaagactgcacctctataagtttgcaggaaccacagcattattgggcctggggcccaaatcccttcaaatacctgggaagcctttccaagaaagatgggcacaaacaagcccagactgagaacactacaataaatacctaactcttcaatgcccagacactgacaaatacccacaagcaacaataccatccaagaaaacatgacctcaccaaacaaactaaataaggcaccagggaccaatactggcgacacagagataggtgacctttaagagagagaattcaaaaagctgctttaaggaaactcaaagaaattcaagataacatggagaaggaattcagaattccatcagataaatttaacaaagagatttaaataataaaaagaagcaagcagaaattctggagttaaaaaatgcaattgacaaactgaataatgcatcagaataccttaatagcagaactggtcaatcagaagaaagaatcagtgagcttgaaaacagactataagaaaatatacagtgagagaagacaaaaaaaaaaaaagaataaaaagcaatgtagcatgccttcaagatctagaaaatagcctcgaaagggcaaatctaagaattattggtcttaaagaggaggtagaaaaagagatagtgatagaaagtttattcaaaaatacaatatcagagaactgcccaaacccagagaaagatatcaacattcaaatacaagaagactatagaacaccaagcatatttaacccaaagactaccttaaagcatttaataacaaaactcccaaagttcaaggataaagaaaggatcctaaaagcaccaaaagaaaagaaacaaatcacatacaatggagctccaatacatctggcagcagacttttcagtggtaactttataggccaggagagagtggtattacatatctaaagtgctgaaggaaaaaacttttattctagaatagtatatactgtgaaaatatccttcaagcatgaaggagaaatactttcctggacaaagaaaagctgaggaatttcatcaagaccagacctacaagaaatactaaagggatctcttcaagcagaaagaaaaggatattcattatcataagaagtcatctgaaggtacaaaactcactgttaattgtaagcatacagaaaaacacagactattacaatgttgtaattgtggtgtgtaaactactcttaagtacaaaaactaatgatgaaccaatcaaaaataattactacaacaactattcaaagcctaagcagtgcaataaggcataagcagtgcaataagacctaagagaaacaaccaaatgataaaaagcagggagatgaagttaaagtgtagagtttttattagttttctttttgtttttttgtttatgcaatcagtgttaagttgttatcagtgtaaaataacgggttataagatagtatttgcaaacttcatggtaacctcaaattgaaaaaacagacaacaaatacacaaaaaaataaaaagcagtaaattaaatcataccaccaaagaaaatcaccttcatggggaaaaaagaaagagaagaccacagaacaaccagaaaacaaataacaaaataacaataagtccttacttatcaataataatattgaatgtaaatggactaaactctgcaatcaaatgtcacagagtggctaaacagattaaaaaaaagagagagacccaatgatctgttgcctacaagaaacacacttcacttacaaaaatacacatagactgaaaacaaaggaatgataaaagatactctatctgaatgaacagccccccaaaaaaggagtagctatacttacatcagacataatagatttcaagacaaaaactgtacaaagagacaaaaaaatcattataaaggatcaattcagcatgataaagggtcaattcagcaagaggatataaaaattgtaaatatatatgcacccaatgatagagcacccagatatatatcattagagctaaagagacaggtagacctcaatataataacaactagagactttaacaccctactttctttttttttaattattattatactttaagttttagggtacatgtgcacaatgtgcaggttagttacatatgtatacatgtgtcatgctggtgtgctgcacccattaacttgtcatttagcattaggtatatctcctaatgctatccctcccccctccccccaccccacaacagtccccagagtgtgatgttccccttcctgtgtccatgtgttctcattgttcaattcccatctatgagtgagaacatgcggtgtttggtttttcatccttgcaatagtttactgagaatgatgatttccaatttcatccatgtccctacaaaggacatgaactcatcattttttatggctgcatagtattccatggtgtatatgtgccacattttcttaatccagtctatcgttgttggacatttgggttggttccaagtctttgctattgtgaagagtgccgcaataaacatacgtgtgcatgtgtctttatagcagcatgatttatagtcctttgggtatatacccagtaatgggatggctgggtcaaatggtatttctagttctagatccctgaggaatcaccacactgacttccacaatggttgaactagtttacagtcccaccaacagtgtaaaagtgttcctatttctccacatcctctccagcacctgttgtttcctgactttttaatgattgccgttctaactggtgtgagatgatatctcattgtggttttgatttgcatttctctgatggccagtgatgatgagcattttttcatgcgtcttttgattgcataaatgtcttcttttgaatagtgtctgttcatatcctttgcccactttttgatggagttgtttgtttttttcttgtaaatttgtttgagttcattatagattctggatattagccctttgtcagatgagtaggttgtgaaaattttctcccattttgtaggttgcctgttcactctgatggtagtttcttttgctgtgcaggagctctttagtttaattagatcccatttgtcaattttggcttttgttgccattgcttttggtgtttcagacatgaagtctttgcccatgcctatgtcctgaatggtaatgcctaggttttcttctagggtttttatggttttaggtctaatgtttaagtctttaatccatcttgaattactttcatttcagaattggacagatcttccagacagaaaatcaacaaagaaatgtaatatttaatctgtgctatagaacaaatggacttaatagaaatttacagaacatttcaatggctgcagaatacacattcttttcttcagcacaaggatcactctcaaggacagatcatatgttaggtcccaaaacaagtcttaagatattcaagaaattaaaataatatcaaggatctcttctggccacagtggaataaaactagaaaccaataacaggaggaattttggaaactatacaaacatatgaaaattaaacaatatactcctgaatgactagtgggtcaatgaaaaaattaagaagaaaatttacaaatttcttgaaacaaatgacaatggaaacacaacataccaaaacctgtaaaacacagtgaaagtagctccaggaggcaagttcatacctataaatgcctacatcgaaaaagaagaaaaacttcaaataaataacctaatgatgaattttaaagacctaaaaaagccagagcaaaccaaacccaaaattagtagaagaaaataaataataatgatcagagcagacataagtgaaattgaaatgaagaaaacaatacaaaagatcgatgaaatgaaaagttagttttttgaaagcctaaacaaaattgacaaacttttagccagaataactaagaaaaaaggagagaaaatccaaataaataaaatcagagattaaaaaagagatgttacaactgataccacagaaattcaaaggataattagtagctactatgagcaactatatgccaacaaattggaaaatctaaaggaaatggaaaaattcctagacacatacaacctaccaagattgaaccacaaggaaatccaaaacctgaagagaccaataataagcaaagagatccaagccataataaagtgtcatccagcaaacaaaggctcaggacctatggcttcactgctgaatcctatcaaacatttaaagaagaactaattactacaatatagtttatgaagaacaaataatcaggaaaaaaaaactaataccaattctgctcaaactactctgaaaaataaaggagggagtacttccaaactcattccatgaggcgagtattaccctgacaccaaaagcagaccagacaaagacataacagaaaaaagaaaacttgcaagcttaatggtaacctcaaattgaaaaaaacatacaacaaatacacacacaaaaaaagcaagaaattaaatcataacaccaaagaaaagcaacttcatagggaaaaaaggaaaacaacaaaacaaccagaaaacaaataacaaaataacaggcataagttcttataaataatattattgaatataaatgaactaaactctgcaatcaaatgatgtagaggagctaaatgcattaaaaaaaaaaagacctgttgatctgttgcctataagaaacacaagaaaagaaaagagaggggtgaaccctttctttgccctttgccccactcccaagataacaaacctactgcaacccacttccatgataacaacattaatccatttaagaaggcagagccctcatgacctaatcacctcctattaggccctaccttccaaactgttgtaccggggattagatttccaacacatgctttttgggagacatattctaagcatagcagagaggtctttggttcttaaagcaataccactattcagcagccaaaggtaggctgagtttaagcaggtattctttgaataataacaggatcatcaatagaaatttatgtttgagatatacaattatgggattacatataaattttatttcagcaaattactgcatacagccatcatagaatttatcatcttgcactgcaataacccatttactcatctatctcaagtagacagtgagcttcctgagggcagagaaagcttcattttgtcctagtgtctggtacatgacagatgctcaataaacatcagagagaaaagataaaagggacataccagttgacacactgacctgttccctcacatagtattaaagcatagatggcaagttaatctttcattcaacaaacgcgagatacagtctctgccctcaagcaccttacaatatggaatgcaagggaaggcaaacatgaagaaaaaggcctgtattttgaaccgaatcagtcatttgtgagctttgtacatctcctcatttaacttaagcctacaccccttctaacatctaaacccttccactgtatcccttaaaatctatactgtgctctcctacactcccacccctactccctagtccacccctgacagaactttcaaaaactacaacctccacctgagctctcctagaccgaactctcaatgcagcagatagggtttccttctaaaaccccaaaggaatgtgtcattcccctgctcaaaacttctcaggaccctcatcttactcagagtaaaatctaaagtgctgaccactgttcataaggtctgtttccttctctcacttatcatctatgtaaggacaaatacaaaatttttaaaaggcttaattttccctgttgaaaataagagaccctcctcatcttttcttatagcatttacttcagaaaacttgtaagtactttcttctcgctttgaaatgtatataaatccttttgaaaactagataggatcttaccagtttcatgaccaaggaatgtctttctcaaaaaccttggagccatctctttgaatatagacatcaagggagataggagccctatctcccagtttttgtggaaggataatagcccaacttaggtaggcactttgttccacattgcaaaactacatcctaggccaggcatggtggctcacggctgtaatcccagcactttgggagaccaaggagggtggatgatgaggtcaggagatcgagaccatcctggctaacacggtgaaaccccgtctctcctaaaaatacaaaatattagccgggcgtggtggcgggcgcctgtagtcccagctactcgggaggctgaggcaggagaatggcgtgaacccaggaggcagagcttgcagtgagctgagaccgcgccactgcactccagcctgggtgacagagagagactccgtctcaaaaaataaaaaacaataaaaaaaatgacaagttggttttcctctggataatgccaattagctaacattgatggtcactccaattaccaggtgaatctagcgtaagctatatgtggcaagtggtgctgggaagttgtcttgcttgaggactagttattgtttatcttaaaacatgcgtgtaatagattgtatcttcttggctatgtaaaagaatgagatttttttctttgaaatctttcagtagattgcctatgatatgcaacacaatctagtttaatgcttattcaatgataaaagtgttttctttctcaactacctttgtgaagagcatatctgggttggaagattttgtttttaattatatttccccaaatactaccactcttctccttgctccttgttccttcaaagaaaagcctccacctttgttctgcacatatcccctcagtctagaacattccccaccactaccacccatatctgtttggcccatttcctcccatgtattcaggtcgctgctcaatgtcactttcaaagaaagatgatccctgaccaccttgtatcaaacaacaccccttggtcatcacatttctactttacctgtctttattcatcctcatagctcttataactgcttgatgtgtatgtgtttgtttacctgctcattgtctgtcttctctgaccaggataaagtctccccaagagcagagacttttcctgtttcattcacctcttatatttccagggcctagataagagtctggcacaaaggaagagctctttcaatgttagttcaatgaataaattattgttaattatacaaagcaaaagagattcaaataaagtgctattagaatgagccacttaactttgcagaaagtgcaactctgtatagctagagctataaaagagctgagcttttggctacagaaacacctgagcaagaatttatgatagctgagtgcttcttgtcacccctgctttcaaaataactgcaaatttgtgatggacagcaaagagttgtcatcttcatgcaccaattcatatgattcgtatggtcttacctcactaatcaaataatgagggaggagagcagggaaagggactggtttttaataatgaaaagtgaaatattagaatatatgaataaatgttcctgtgtatgaagagaaattaaagaaattctgtccaattcatttatagatttatgcaactccaatcaaaactccaatgcaatttgttcagaaagtgatagaataattctaaaattcatctggaaaattaagcaggtaagataattctaaaaagaaagagattaagcatcctaaagctataataataaaacaaagtgctacggatataaaagtagattaataaaacaggatagctagcctaaaatagaaagaacttattcatgatttaaaaaactcctaatcaaagaagaatgaatgaatgaatgaataataaaacatatcatttaataaacgcttttgggataattgattatgtatttaaagaaaaaataatttgagcacctgttgtacattttatactaaaagaaattctatgcgagttgaagagttaagatggaatcttaaagattctttaagattgaattaagatggaattcttaaagattccatctttaactctttaactcgcataggatttcttatcaaaaacttgataaaaaattactatttattatagatatataattgttatacaatttagaaatatatattattttaatttctaaatatatattaaatataataatatttatatatctataggtggcagatgacatgattctatatctagcaaacctcatagtctcagcccaaaaggtccttcagctgataaacaacttcagcaaagtttcaggatacaaaaccaatatacaaaaatcacttccattactatacaccaacaacagtcaagccaaaagccaaatcagccgaatctcatttacaattgacacaaaacgaattaaaaacctaggaatacagctaacaagggaggggaaagatctctaaaatgagaattacaaaacactgctcaaagaaatgtgagaaaacagaaacaaatggaaaaacattccatgctcatggatagaaagaatcaatgtcattaaaatgggccaatctgcccaaagcaatttatagattccatgctattcttaccaaactaccaataacattctttacagaactagagaaaactattttaaaattcatatggaaccaaaacagagcccaaatagccgaggcaatgctaagcaaaaagaacaaaactggaggcatcatattacccaatttcaaactatactacagggctatagtaacaaaacagcatggtagtgttacaaaaagaggcacctagcccagaaataatgctgtatacctacaactatgtgatctttgacaaatctgacaaaaacaagcaatggagaaaggactccctattcaataaatggtgctgggataactgtctagccatatgctaaagattgaaactggaccccttccttacaccatatacaaaaatcaactcaagatgaattaaagacttaaatgtaaaatccaaaactataaaacccctgaagacaagctagccaataccattctgaacataagaacaagcaatgatttcatgacgaagatgcctaaagcaatcaggacaaaagcaaaaattgacaaatgggatctaattaaactaaagagcttctgcacagcaaaagaaactatcaataaacagacaacctaaatagtaggaaaaaattttgcaaactaacaaaggtctgatatccagcatctataagaaacttaaacaaatttacaagaaaaaacaaataaccccattaaaaagtggacaaaagacatgaacaggcacttttcaagagaagacataacatgtggccaacaagcatatgaaaaaaagctcaatatcactgatcattagagaaatgcaaatcaaaaccacaatgagatgccatctcacaccagtcaggatggttattatttaaaagtgaaaaaataacacatgctggtcaagttgtggtaaaaagggaacacttatatattgttgatgggagtgtaagttagttcaaccattgtggaacgcagtgtggcgattcctcaaagacctaaaaacagaactaccatttgacccagcaatcccattactggatatatgcccagattaatataaatcattctaccataaagacatatgcacatgaatgttcactgcagcacaattcacaaacaacctaaatgcccatcagcggtaggctggataaagaaaatatggtacatatacaccattcaatgctatgcagctacaaaaaagaatgagatcatgtcttttgaagggacatagattgagctggaggccattatccttagcaaactaatgcagaaatcgaaaatcaaataccacatgttctcacttacaagtgggagataaaggataagaactcatggacacaaagaggggaatgacagacactggagcctatttgagggtagagagtaggaggagggagagaatcagaaaaaataactattgggtactaggcttaatacctgggtgatgacatagtctgtacaacaaaccactgtgacacaaatttacctatataaaaaacctgcacatgtacgctgaacctaaaataaaagtttaaaaaaaagttaaagattgaatcatagacaactttatgaaaaaaagactttattctagatatataaattgtatgtaatttataaatatatatttatttcttttagatataatatctatatatctatagatggcctttcgagacttagaacctgctatggtttgaaagtgtccccaaagttcatgtgttagaaacttaaactgccattgtaacagtattaagaggtagggcctttatgaggtaattaggccatgaaggctccatcctcatgaatggtttaataccaactttgcaggagtgagttagttatctcaggagtgggctcctgataaaggataagtttggcccccactttctcttcatctagggtactcacttccacccttccatgcttctgccttcttctatgggatgacactcattagatacagccgcttgatcttggacttcccagccaccagaatcacaagccaaataaatatgttttctttataaattacgcagtctgtggtattctgttatagcaggagaaaacagactaggaaactataaaaataaatgtaaaaagactagaaagatgtgatgttagaaacctatggtaaaaaaaaaagcaattatgagaaaaagtttttgttgtaaacatgatagatctagcttaatatgttgaataaagagatcaaacaagcagataacagaaacactaaaatcccaaaagataagtgagcaaaggtcaaaaacagacaattcatgaaagaggaaatacatctagcaaaaagacatatgaagcaggttctggctcttatcctagattctgcttctggtatccagtccactgaactcttggtttgatgcttcctgacagccaataattagcctccattttgctcttcaactgtgcccttgcttttcaactagaatttgatacttcattgctgcatcttctgttctaactttcacacattctcagttcccagcttttctatgccctgccttatggaagggtaagaaaaccataggaaatctctattttccttacttcatattttaccattttattcattcagtgctgctacataaaggcctatattttattcttcatcactttttcttttatatacactatccaaacaggttaagtaatcccatacacaatgtacaatgatccgtgttgtgataactacatgcaaacacatagttagagttccgaaggaaataaggaaggaagaataggaagagggagaaagggatggagggagggagggagggaggaatggaaggaaggaaggaaggaaggaaggaaggaaggaaggaaggagtagggagaaaaaaagggaagatcatataagcaacactttaaagcatccaaagcaaatacaaattccagggcgttgttaatttactaggcattatagatgcatttgggggaaatataatgtttgcaataccctgtgaaaaactaatattgatatcaaaatataaaaagaaagtaaaaatgaataacgtaattgcctgcaaaatgtattatgagactcaattaactttaaattatgctatcataaacaattcattatatttaaaaagtttgtatattagtttatcttactacaaaagaattcccaatggtacctaacatctaatttaaattaaatagtatttatgtgtgagcaagaatcacaacacatgaattaaacattactcataagatattaaatttcaaagtacatttataaaaatatttccaaatttttctatatcaaaaactacgtttaatgttgggttgcattgtaagtatattttaatacatttgctatgaagtgactgaagcctccaaaaacaagagtgcttaaggcagaaaaagtttttcaatggttgtggcacatgctttgaaaattcagatatgtccaggaggagcggagggttctctttgcttaatgaaacttgtcttgaagaaaaggataggcaggaacacagataatagtttccaagtgaggactgagtttgaaatagcacagtaatgtgttgttaaaattgtccttagagtcagctgaagcctaggagtcaggggtcagggggtagttgggaggagaagactaaaatataatagcaaattaaaaattatataatcatatcagcaaaatctctaaaaggaactggtgaacacaacttggcacaaatagtagtggagggtattagccacacttcaacatgtggctggcagtgtgttactttttgacacttacctagtggagaaagagtggggccatgttaccagatagagacggaggcagccagttatgtaggagcactacagcctgggcactgggccagctgcctccactgatcatcagcttgagagctagggccatgcagccagttaccaagtggagagaaaatagtgattgtatggccagtgctaaccttatgaacacatatgaaagacatgaaaatcccacaatagatatacaaagacatttttgtcatgacagttatgatgtactcctagcaggtaaggcctagagaaacatgggttatataaagaattctattaagtagacacatagaaatccttgaatatgcattagggaaaaaatgttgtcaaatggtcaacttggccatgttatttctgaaaatataaggtactaactctgtgggaaactttccaaggtttaacttttgcttttgtccttgctacaattgttgttgcaaacttatagtaaaacattagtcagatctagatcaacaaggacactgcaaggtatttccagcatggaaaacaaacttcactttcccaaattccaattctgtcaaaccagatgatgcatccatttggaaaagaaaagaaaacaaggcaactacttcagagcaagcttcattaataaatgcagaacagtctgttatctgtaaaaatgtgcagataagagaggaagagaaaaatctgcaagattcccaggctttgttgtgaataaatatagcatggctgtcaaaacaaaattgtaaaccgtattatgtagagtttccttttgttaatttggaatttaaatgtttaagtccaatcccctaaatgcaaaagtgatcaatcccagagcaatatgattactgtttcttgacaatgtggatagaaaccatcaaagccatatgtatacttaaaaacaacagacactgttatttttattcactttattttattttatttctctgaaacccatacacacagaataagaatttcctctgtatgtaaacaatataaataaaatatgcattggatatgagataatatcatatgaaatctacagaggaaaacattcatttctttatcaggcagaatcactatattagagatgaatacattctcttaagactctcaaacacttttaggttgcctatcctttagttttaaggtacattactaatacaacatcttttaaatttgaaccaagtgactttttaacatctattgaagctattggtaccttcaatagacaggagatggatcagaattctcgtggttatttaagaaatacatatgtaagtaagttcaattcacaactgagcttatgtttcctctatatgataaacatgctgaaaacaagttattcagggaaaatttttctggctgtattggaaagcttaggccaaagtcaaagagaaaagaagaactaaagcaatctagcttttcccatatgcaaacgtctatttcgaaacataggatgctgatttacagtgaaatttccgagtcaaataaaaatgaagcattgttgtatagtgggggaaaatgctggcctcgcatcaaaagttctacattccaatctcactttgttcttgctagctgataacctatgccaagtctcttatgggccttattaaatgaggagtgaattagatcatttctaacgatgttcaactctaacattttatgaacctctaccaatggaatcaatgtataagaaaatgagccaaacaaaagaaaataaaaggtattaaagaaagtggaataactaacagagaactatactcaatttacattgaaaagacaaaacattttgtaccattctaatctcataaataaaatataattcaatctattttgtgcaaaacacagtttagagaattacaaaataaagatatgaccctaaaatctactttagtttattgtgcatataaagaatttcaaactgatttaaatttaggtgatgtttccaattttatgaaacaggaaaaaattaccttaaatcactgcatccaagatttaagaaagaatttcttcataatacagttaataaaaattctttctaaaggaatttgtgaaactgtcctccagatgattcgattgtactttctattatactgcatggcatcaattttaacatgcacattttcccatatgttcacatttctcaaattaggatatgtcttccaagtgatggcatcttagatacaataaaatagggtagtttttaaaataggcatgccttatcttctctatcatattgtatttgagaaggaaaaaatagaactgtgcaagaaatcaatatcaagtcataataaacaaataaaagaaaaataaaatcccaattgttgggataccgaagaattccaactagtttacagatactccccctccaggaagaggagcttaaatctccccaccttgagtgtggactgcattagtgacttacttccaaacaggagagtaggaaggggaagggacagggtgaggaagtaaccttgcagtggaaaaacctggcaaacactacattggtcagtgatcaaagttaatatcatcattgataagtcatgtcaatagaatgtcccctttatataatgtcagagaatgtcactttacctttgtggtcatcctccccaaaacccaaaccccagtctaaccctaaggaaaatgttcagacaaatcccatttaagggccattctacaaaatgcctgaccagaccagtattcctgaaactgtcaaagtcatgaaaaacttccttgtttttcatgtctgaaagactgtcacagagcagaatgtggagacatgatgattacatgtaacactgaatcctggcacagaaaagacattaaaggaaaaattagggaaatctgaataaaatgtagagtttagttagcaataacatatcagtgttggtttattggttgtgacaaatgtatcatagcaatataaggttacaatagaagaaactgcaagaaaggtatacaagaactcctctgtactatctgtaatttttctgtaaatctaaaactattctaaaattaaaagtttatttaagaaaaccaagccatgcataattttatatacatattctacaataaaatgacccaacaaatcaaaatggaagagaattagatcctaaactaatccagatttttagaaaaataaccaagctaataagtgtaataatacaggaagataaaatgtaccaaagagaattaagaggctcttatctcaattcttaccatgggaacaatttttcatttgtgacaagacctgaattatatgttagtccatttagtacaaagtaaccatcaaaatagttaaatcctcaactgttgtacactcctatggatagcaatatttctagaataatgaaccttgtcctccctttttctgataacccatcataactctggatgtcttgggtttccaagaaagacttgtgggaaaatatgtgaaacaagtcattaaacttgggcttcaactgctatacagctcataaaacaaatagaactaaactgatttatttgagccatctgattttttgctcaagagacagggtcaaaaccaccctttagggttcaaatggtaatattctttctctgtatgaacatgagcagtgtagtcaacaattgctatgtagtctaattccttaattgactaaaaatactgtcaggccccaacttataatcaaattgtgttttaaactgctgtcatatctgttatgtataatttataacacatgttctcaatgacaaaattcttataaaggatggctaaatgcagtctagttcagaaaactttttaacccgtaaaataaaagatgttcacagcaatgtaaccaaggtgactactgccctgaaaatagactatgagccaactctagcagaaagcgagccccctccaaacaaacaaacaaacaaaaaaacatatcctggattattccctattcagactccacctcatgttttctaaagaaaatggaaagtaagcatccagggtaagccagttgcagtgtttcagagagtggatagaggtggaaagcaggatttataatattagatagaaaggaaggatagctaatataagaaatactctgtgaacaggatttttccactaactgtcagcagcactgaagtttcaagaaaaactgtggacatttccaaggtcctggatgaaaaggtatggacagcaatccccaaagccaaagttatggccaagaagagctgaagatgctttgcataaccaagcaaggcactcagctaggaaaaacactagaatggcccactaagacaggcaagaaagtcttgagcccagggcctgccaaggacacctgaaggattccaagtaacagtggaaggccacacactaaatagagtgcaggctttggaaataaatctgaatttgaatcctctgcctttaattagacctgtgaccataagaatctttcttaactgctctaagacgcagttctttcattcatcaaatcagaataaaaaatatccatttctgaatttctaacagttttatattgatgttctaacaaattatcacaaatttggctgctgaaaacaacacaaattatcattttacagttctggaggtaagaagtctgaattaggccgcatgggctaaaatcaaggtgtcagtaggactgcgttccttctggaggctttagggaagaatctatttctctgccttttccagcttcagcaggccacacacatccttggctctttaccccatttctctgttctcaaagccagcaacatggggccaagtccttctcatgctgccatctctctcctgcctctctcttccatgtttaaagatccttgtgattacaccggacccacccaggtaatccaggatcatctccatattttgcaggtccattgattagcaactttaattccctccgccatcctaattccctttgccatgtaacacatttcatatttatagtacagaattagagcatagaaatcttgggggttggggggtctattattatgctaccacatcatcatatagagtgtgagaattatatgccataatgtatataaagcagttggcatgtagcatgagtccacaaaataatagttttctcagcctccccagcttccctccctcatttaccatcagaaatcttcctctaataaatctcttgcatatctgatactgtgtgaacatcttcttcttggatgacccaattaaccagttacatcaactccagcagagcttccatactgtcaagaatcatagtattagaatcaaaagacacataataaatgctctattccaatcacttcattttataaatgagggaaacaagaccagaacaaagagtaacttgcccaaggtctaaaatcagtaggcagcatagcttgtacaagaatacttgtagcaccattaggattattctatgctgcctgtgggattctggggcaggaacaagctcttttatgactacaaaagttgatattccagtgtaaaacttctggaagtagaaaagaagattctaacagtgatgaatctcaagggaacagagaaaaggagtcctcttctagaagaggacaggccaggcacgatggttcatgcctgtaatcccagcgctttggaaggccgaagtggtcagatcacttaaggccaggagttcaatacctacctggccaacatgacaaaaccccatctctactaaaaatacaaaaagaggtttatgaaaccatcagatctcttaagaattcactcacttatcatgagaacagcatggaggaaactgcccccataatcgaatcacttcccaccaggttcctcgcttaacatgtggggattacaattcaagatgagatttgggtggggacaaaaagtgaaaccatatcaatccccaagaacgtggattatttctcatgtgactttctcaaacaacactttttctccaactccctagcaatggtgctaaaagaaggaaagtacacaccatggcaatagcatcaaacaatagttttaagaaggtgaagcctagaatagaacaaatttgtgagaaaagagcaccactattaatatatgaatattgagcactatgtctgttttaaccatatattccatgttcaatatatacctacaacagtgccatcagtagaaactcactgtccttgctctaatacactcaatattttcacccaaataatagaatcctttcccccaattagtatgagtgtagaagaaatgacaatgatctacagtgcaacttctcatgtaatcagaaattggtagagcatgcaaatccaaggctgatgtattcacatcatgtccgaatatcaggctttgcattagtagtggggatggggtaggataatatcagtgtctgatttctgcccacgtggtcagccaccattagtatgttttgcaggaaagtggataagtgaaaaccaacttaagcttcttctgcttcaaataggatattttcatcttttcaagccatgtattttttctttgatgaatgttttataagtcttctctattttctctccttcatagtaacacttctgttggacatgaataagatttagaattcatgactgtctgtgacatgtcctgaaaactagtttcactatctcagatcataaactgtacttgtctcatgtcatggagcaaaagcaaaatgtcttcatcactttttaaaatcaccatgtaagtaaattactcttttgacatatgccttaaaattatcttttacctcttagcaaagattaaatgccttagctttgccctacaacaatataacactacttcttatacttccatctctgaacctgaagaatctacattacagccaagcatgctccaagaatctacactaaaaccaagcatgctccaaagtcaatctgatatattccttttctctcttgaaacattgtatattaactttcatttttatgacttgcttttctcacattgttatcgtagcttctacattctttatccttcaaatacatttttataattccctgattttacccaataataagattaaagcatgtgagtgctctaggcaggctaatgacatggtattccttcataccaatattctttaaatactgtacatattcaacataggtttatatacttaacactgtccaggagataggcaaagaatgaagaaagcactttcctatggctttgttttcattctaactgttgaattagagctttgacttccagatatagggccactggttggacctgaacccaaatgaattgatgttatttccaggacatagtccctgggtgtggaaaccagttgtgtaactgactaatactggtaatatgtaaagtgtgtaatggcagcacattgtttaaatttgccaaagtctggctcgtttggtttaagagaattttttaaaaattaaataaatttgcccaagtgattttttgtagttgacaatccagcttttctatctaccaatctcaaaaaaagagacatactgcaattagtaaaaattatttgagaagttttcaagacttatagattattatttcaaaacgaaacagcataaatagcttactttttcattttattacttttctatgatagtaatctgttttaagattttctttacatttattcatttattttgctgccaagtgtcctgagactcttctggcattatttttgattacagggagtaggaaaaaaaagactttaaaaaggccatttatttttccaatacaaatttcattatggaggtaatattaatcataaaagaagatactaaccaaaaaaaggagaaaaaagagaaatgaaaatatattgtgtccaggttagaaggtctctgataaaagacaatctaaatctcccaatactatacagtaaattactaaggtaataatgttctgtcatgtgaatatccattcctattgtactttatatgatttgtgagttggtgatgtatgaagctggcattgaaagcaagatcagtgagtaatttgattaaacatgctgaatttacagaatttacactacttggatactaaaaattatcaggctttctgtctcactaaaatttactaggaaaagaggcaagttcttcctagaacagcaattctcaagctatggtctagaaacaagcactttcctgaacatttggcttggtagaatagaatgaacacactatagagggaaatatcccaagaggacattgagagaacactgatatattaggttatttctctttttcagtgagtcttcagagtagaacatttggagtgccactaaccattaaaattgtattccaagatcttagaagggtactccaagatcttagaaggatatcccaagtacctgtcttatgcccctatcagcaatgtgccccaaaatccccattcctgacctacttagcttgtagtctatgaaaaggaaccacagtaagataaagaaaagtgaaaaattgtcaatgttcaatatacaacctatatttttcaatcagatttatttatatgaccacacttaggacaatctcactatttgcaattttctgaatcaccaaaaagaaataaatagggaagcaaaaaggttgtataaaatgaccacagaagaatcacaattatttcaaaattttgccaaataaagaaatcataagacatgaagaaatcataaaatctctattcctctttgagctctatttaatgcaagtctttcctagtcaattaacctccaggctttatatcattaatctaatatttatatcattggccattctgtcttaaaaacatcatgtatgtttcattaaacatccagcaacacaaacaacatgatgcattaggagatggccagtcctagaaagagaagctctgattaacctttcattatttattcacataagaagtatgaattcacagaagaaatctagatggccatcaatcaactccagaaaagaaatgattttgtttttaatcacagctacttatgtttgcattagccaaattcctcattatatttgtagtcaccagttttgtaggtatgaaaggaagttgttgtaatatgttggtggtagcagcttcctgacctctgaatctcagctctggatctcagtttcatgatatcccttctggcttccactgccccagccattctagcaggtgttataagcacctaattctctctgttccctcaattccaagtgaaaatgtctagagtggttgctatttccagcactgaactcattgacagatgccttctctgactcctcttccacagcaggagatgctgtaagtcagcaccttgttactactcaacattcaggtaattaatatcctcgattaacacacactttcaaactccttaccatctttgtcttgcctgttaaaaacactcacagttatctgaatctgtaagtgtgtttttcattttaaaaacatttaacaagcaagacaaggaaagggcaccttctagtgcctgggaaaatgacatcacaaatttgcatacttcctctcttcaaaaagggaaagaaagaagcagaaagtttagtgtcttatacaaaatcccagggcaagactctgattggctcagcttgaatctggctctgacatgcatccctggaccaatctattgtgactagaatgaagctcacataataaaaaggtgtctgctagaaaccactcctctaacaatgagtaaagggaagacgtggtgatctgagaaggtgagataaacagatattctagtagatttttattatacctgtgttcaaatcctagctttgctaattgccagctgttgacctagggattgttatggaatctcactaacacagagttttcttttccatcaagagaaaataatttttaaaatttacatcgtaagatttctgcaaggattttttttctttttcttttttttttttgagatggagtctcgctctgtcacccaggctggagtgcagtcacatgacctcggctcactgcaacctctacctcccaggttcaagcaattctcctgcctcaccctcctgagtagcggggttacaggtgtgtaccaccacacccggctaatttttctatgttcagtagagacggggtttaaccatgttggccagtctggtctcaaaactcctaacctcagctcatctgcccaccttgacctcctaaagtgctgggattataggcgttagccaccacacccgacctctgtaaggattattttacataatacaaatgaagcaatgggcacggcatccaatatattgtaagtgctcagtaaatctgagtagtttgtttttatcattatcaggatgcttcagctaagtgggaacaatcaccatcagttttcttggcaaaagaaaccaaaatttacccttgatttcatttgcttgatgtctagaccctacacccaaagaccatctgaaaaaactgaccacacaaactcatatcaggttatcagctcaaaaaggacatcgcctttctagctgaacttaaatgacacaaaggcaagataaaaggaatccatgattacagtcatgtcctctggagaagggagcaatgcacattcacctcaatacatgtgttcaatttaatctaatacataaaagatctggttttctgggagccttttgttaccaaaccagcatctacaactataaataaggtttatttaaatgatttatcttgaattacctaataatttcagacaggggttagtaaattttctctataggctttgcaggccatatagtctctcttgtgaatattcaacttttcaatgaagcacaaacacagccatagacaatacattttttataatgagcatggctgcattctaatacaattttgtttacaaaaacaaacagagatctgtatttggctgataggctgtcaattgccaattcctagtttagatacaaaagtccttccctcccttcctacctccttctaccccttctcatgatcctcaattatgctcctacgaatgctctaaccccagttcatcaccatcagatgaatcattctaaaatactgttgtgtatgccattttccagctcaaaatccttcaagcatttctattacctaaaacaaaacattgaaactcgatcctgttatttaaaacattctataatccggctctaactgattttcccatgttatattcctcttctcttttacagaaatcatcccataaactgatctattcatgcttgcccttggatatttccttcttaattcttttcctcatgttttccccactatagcagtctttcgctcccctatcttcttcaccaattcaaattttttatattcttcaaggtccagaaacaaaaataataactcgcgaataaaaagtaccttgatccctttagatcccaattatctttcttgtgacttttcaaataaaagctattgttcatatcactcctgcggcccttatcacatactatttactcatccaacttgtgttggttgtgttgctgctgctgatgtcattttattggaagagcagacagcctgtatgtttcttgaaagtagtggctgagtattaaacctctttgaagagcccagcagaccttttggggtactttgtacatacactgaatatataattcattaaagctaaaggacaaaaagatatccatgtatccctttttgcagtaagtgcctttcagcaattagtgggccttttaacaaaaaaggagtttgaaatgattctataaagaaaaaggacactttgtccccaagaaagaacccagggaatgattattcaggatgtataaaattctggacttttgtttttgttttacctaaaaccttccacattgaccgtttcttatcatcctcttcaaaactgtaggtaagaaaaaaaaaaaagaaaaagaaagtacagatcattcagtattcttccttcttagaggcttcgggggagaaaagtttaatgggggagaaatagtaacaaatacctaaaagatttttaatgctttatgaaggcaattgcctgtgtttttgctgtctctcataaccatagatgggtaattgagaattagcgttgcttctgtcaagtgccatggaagcattttagtttcaagctggaaagattcagtgacattttgcatcatttaaaataataaagtcttatgcatgtggtgtcattataagcagtaacttttgatatctgaaaaatgttgcattctatttataaaaggaccctgtttttacacagaattttatttttttaaagtaattctgttactctcattctccagtctaacaacaaaaccattttcagccttaatcgcccaactcaaaataccagctataatactctcatgcaatagaaagatggtttcaaagctgccctccccaagtatttcacaataagagagtttgtatattctagattatagacgaggaaaggaaaggaaaagagaggaaaacgatgaggctagaatcaacttttctagtaaagttttatcaatttatgatgcctgctgttcaaaggaaaaaatccaaaacaagcaaataaataatagaggtttcaagtaaagagcacatttcaaaaaagggtccacagccttcagggaaagatgtaccataaaacaattatccttgataatactgtatgcccttgtccccagctatggttataactcacatggaggtcaactcagcacccaggggagagaactactgcctatcagaaaaataaacaacaagaaaataaaacacagaggagactgtagaatgttcttttatttggagaaggtgaaaaacagcctctgtactgcacatgcacaaaaaattaataataaccacatgaaaatcaagcatttagttattttcccccacatcgaaagacactgccatttaccttgtcaactgagaacaattcctctcctcccaaagtcatatttttgtttcaatttgtatagtattttcacttgcatggttttatctctatagaattcctgcaggtatgttttctacctgtcaggttattttttatttgccattttagtttgtatctaaaattctatatatgcttccaaagaagaatcaaaacttattttggagttaattgtacacaattatcaaatgttctttggatctaaagacatactaatatgcaccataatttgtttctgccaaaaaaaaattttctctcttcatctgtacaatgctattttttctaattatatgtgatgctttattaatggtatctcataggggaaatatgcccagattcttttttaaaatgtaagcaatctaaatatgttcaaagttgtgccacaaaattataaaatagagttggaaaacaatacaacaagtttttttgtgagattaacccagcaatagctttctacatgcagtcaaataatcaaatacaacaatgaagtagcaatactgtggtataatcaattgttttcttctctttctacgtaattataattgttctactatagaaaagtttaggtgctaccattgcttttaggataatcagatatgcagagccaaaaactgagacatatttttctccctaggaagaatttcagtgttggctgtacattcatgtgtgaacaaagccaaagaagatggcaagagtaaaatatgggtttgctatatccaaagcgggacaaaatgagcttccggggaaatgagggtagagaaatatcacaaactatgagatgtcaagcggtgtttgaaaatctaaataatatctgatggtagccaagacatgcctataaaattgtttcttacatatgacaaacagttgtttgtctttctggatttgtaccactttcccactgattcttcatcataacttaataccagactctaacctacaagcactttaaaagatcatagctatgttatggtgaagatccacaattaaggtagcaatcaatagatgctccctaaatttcaatgtggaataacgagggagcagacagaaaaccaaaaggcacactgaacaaaaagaataatgttgctgggcacagtagcgcacatctatagtcccactggctagggaggctgaggtgggaggatcacataagcccaggagttcaagactgaagtgaactatgatcacaccactgcacttcagcctgggagacagagtgagatctcctctcaaaaaaaaagaaaaagaaaattgttgaactggaaccaaatctcatagtaacaaagtttcacattttaaaatttcagagggaaaacctactttaatcactaaaaatctacagtctgagcatggctagttaagtttttgactacacattattgtcttggtaaaccaaatattgacagaatcttccagcttttttcatgctcaataaccacactaaatttgaaatattatgatattagccctacataagtttggatgatcttagtccttcacagttttccctacttttagacttcgttctctaatagactttcatgccattcaaatattgctttttttaaaaaaaaatcctttattatctacccctaggcatcatttcacacatcctttacacctaaaatgataaacatctgattcccatttattgaacaacatattttcattctaaatactcatttaatctaacatcttagagaacatgtgtttaaaaacataggctctatggttgactctctaggttgtaactcatgactatgtgactagtgtgactgtaagtttctttattttattttatttattattattattattatttttgagatggggcctcactgtcacttaggctggagcacagtggtgcaatcatggctcactgcagcctcgacctcctgggctcaggtgatcctcccacctcagcctcctgagtatctgagactacaggtgtgccccaccatgcctggctaatttttgtattttttgtagagactgagtcttgccatgttgcccacgctggtctcaaactcctgggctcaagcaatctgccatcctcagactcccaaagtgctaggattataggcatgagccactgtgcctagcctccaactttcttttttttttttttaactttaagttcagaggtacacacgtgggtttgttattaatacattggtaaacttgtgtcatgggagtttgttgtacagattatttcatcacccaagtattcagcctagtacccgttggtgtttttcttgatcctctccctcctcccacctgccatcttctgataggccccagtatgtgttgtttccctctaggttaataaagtagggaataggccagttgtggtggtttatgcctgtagtcccagctactcaggaggctgacgggggaggattgcttcagcctagaagtctgaggccagcttgagcagcatagcaagaccctgttccttttaaaaaaaaaatggaaaagaaaggaagaaaaataatttaaaagttttttaaaaaaattagtgtatgcaccgccattgtagacatgtgaccacatatattcagccacagagtgtcagtatagaagtctttaaaagactgaacaaatcttatgtagcatggattgcccctccagggtacagagatgtagcttggaggcactcaggccccctcacatctgtgtacaagccttctaactagttctcatcaaaagaacatgtgaacgtaagtgatatatgccgttttctgctggtgctattaagaagcaggtagggatttttctctctttccccttttactggttagaggcagatgatacagaagtcacacaatggaatcagctttttattcctggatcccagaattaccaggtagatgaaagctgcccagcaaccgggaacacacacattggattatcaggtgactgagcaaaaaattttttattgtgaatacccccactgaaatgagggggtttctttgtcacaacagcaaatgacagcttacctaaaacaatcacttctcctatttttattttcatttgttttgatgagaacttgcattcgtataaggaagcttaagcttaagttcactgctttgaggcagatgggtacatcttactgtctactgtcagaggtagttgggaaataagaaagggttggaagagtgtacctgggaccaatgctaattttttgaaaattctgtgagctgaaaactctaagaacaaaaaacagtcttttctgttcacttaaagctttaaaaagcactgcataaaaaatttcatgagagttactaaaaggagacatacagtgttattcattctatccaaaatcattctgatttcctgatttttctccgtactttcaaagtcctaacacccttaaaaatatactaaatgaaataatagaaatgtaagaatctcttatgaaggacacataaatccccctaaagttgaaatcaatttaatcctttttgaagctgctttgttcaacctctgaaaaacatatgcatgtttaggaaaagtgggtttttttaaggatgagttcatgtccttcacagggacatggatgaagctggaaaccatcattctcagaaaacgaacacaggaaaacagaaaaccaaacaccgcatgttctcactcataagcgggagttaaacaatgagaacacatggacacagggaggggaacatcatacaccggggcctgtcggggggtggggggctagaagagtgatagcattaggagaaatacctaatgtcaatgatgggttgatgggtgcagcaaaccaccatggcacatgtatatctatgtaataaacctgcacattctgcacatgtaccccagaacttaaagtacaataaaaaataaaaaaaagaaaagtgatgttctttaatttttaattttaatttttgtgggtacatagtaggtgtatatatttatggggtacataagatgttttgatacaggcatgtaatgcattataatcacatcatgtaaaatagggcatccatcccctcaagtatatatcctttatgttacaaacaatccaattatactcttttagttatttttaaatgtacaattaaattattattgactataatcaccctgttgtggtatcaaatactaggtcttattcattctttctaactaactttttgtacctattaaccatcctcacctcccctgccaccctcctactatccttcccaacctctggtaaccgttctcttgctctctatcttcatgagttcagttgttttgatttttagatctcacaaataagtgagaacatgtgatgtttgtctttctgtgcctggtttatttcacttaacataataacctccagtcccaaccatgttttgcaaatgacaggatctcattcttttttatggctgaatagtactccattgtgtataagtaccacattttctttatccattcatctgttgatggacacttaggctgcttccaaatcttagctattgtaaacagtgctgcaataaaaataagagtacagatatctcttcaacatactgatttcctacaaaagttctttttaaaatcagcttctcaaagccaatccagccttttaggtaaatacgttactgagtttatttttttaaaggcacattatatatttgatagatcacttgaatcttgtctagacatacagactgccttagacaagtgatgtttccttattcaacagactagaatttgtgttatttggcaagtttgcaacacacacacacacacacacacacaccgcagtgagactataactatgacccaaatctgtgttactttaacacagaattcctcaaccccagcactattgagtttttggggccagaaaaaaactttgggttaagattttttgtctttttcttttctttgacacagagtcttgctctgttgcccaggctggagtccagtggcatggtcacagctcactgcagtcttgacctcccaggataaagtgatcctctcacctcaacctcctgagtagctgagactacaggcatgtgccaccacacccagctaatttttgtcttttttatttatttatttatttatttatttttgtattttttgtagagaccaggtttcaccatgtcggccaggctactctcaaagccctggggctcaggtgatcttcctgcctcagcctcccaaagcacgggggggtggggcaattaccggtgtgagccactgcacccagccaagacctttagtcttaacaagtaattctgtgttgtgggggttatcttttgcattgcaagatgttctcacatccctggcctctacatggtagataccaatagcactcacttccccttttaaacacaatataacaaccaaaaatgtgtctaaagattgccaaatgtcccctctagggtaaaactgcccctagttgaaaaccactgcaccagcaaaaagcttccatttctcttggaatatcagaacgtaaggatgtactaagcttacaaagcaagcatctattatgaagctaaatctgaacttcaatggcttaaacttctgctgaagcagtggtgctagactatcgtctacagcttttactttacggattcagtaattccttcccaatctcaagttcctcttttaaaaatttcattaaaagaaaacttaattctgtttaactcttcagaaactgaagaaaaaaagaactggattcccctaataagagttgcaaatccttcttgttgaggatagtaagaaaaagagaaaacaggtttggtacaagaggggcaaagtgaaagttaaatcgggagtggatgtttttagacatgcctgcatcttgccaaagatgagaccatgtacattttggccttaattatgtatgcttttgtctctgtgaaaaggaagacattttagtcagtgaaatatttattatgtaactattaagggccagaaactgttctagggtctttctgcaaaaagaatgagaatgtttgctccaaatataaaaaaataaacaactataagatacacagatcaatgatggaaaccattgctctttagtctcctacaaactctttgctaaagcaaagtagcaaaattgtgtctttcttaaatcaaatcgtaccaaaaattataacctcacaataagaatactttccaaaatcatcacaaaacttgattcaatgattatttagttatttactagttgctaggcaatgtggcaaatgtgtaagtttcactgcatagattcactcataaaggaactcacaaacttttgagagaagtttgatttacagcagcctacactccagccatattaaagtatttgtacttcctggactttcacctatatttcatatctctgcacttctacacagagatatgaatactaatcactctatacatagaattacatttcccctcttatctgttctatcttagataaaaatgcagcaggactagtttccaagacaacaggtcacaagacatcactggtaaaacaagagacagtgaaggaaactggccaaaaccagctagaaccaaaatggcaatgaaagccatctccagttaccttcactgctcattatatgctaattataatgcattagcatgctaaaaaacactccttccagtgccatgacaaatgtcatggcaatgcccaaaagttaactctgtatggtctggataggggagaaaaccaccgttctgggagctccctgctcctttcccagaaaactcatgcataatccaccccttagtaagcatatgtaatcaagaaataaccacaattataaccaatgacgagcctgggactggggggatagggtgctctgcctatggagtagccttccttttgttcctttgttcttccaataaacttgctttcatttctctctgttggctcactcttgaattctttcctgcacaaagccaaagccaaggaccaacttggccttctgagttgagccccaattctgcatttcaccttgcaacatctccaccttcaaaatgtaaagcccttcatgaccctttccccaaatggagttgatcacgttccccttttacctttctccatagctgtacatgtttactgaattatcactacgtaaggcaatcacttgctcatatgtttctctctcctcctatacctagtttcatgaatacttgaatgctatctttaaatgttgtaaccttgtaaaacagtacaacaaattaatgttagatgtatgacaaaatgaatgaacaatatatgaagtgaagactattattacatgatgaaatgcttaactattacaatctggctaagatcatccttttctttaatatccagataaaatgtctcaagccctcatcatacatgctttccaggattttcaaagattcccaggagctttacactctcaggacacctctcatggaattctcactcactgtcttctatacttgccatgcttttcatatatgctcacgctatatgtctccaccacacctcctctactattctccatacttgactaaaaaaaatccataacatttgtactaaatattagcgataacagagaaatacacaacaacacagaatatgaaactaataatatttcatgtcagatatccatgttcagcctattactttattatgcagagcaattagctatcactttccatccaagactagagtctaagtatacctttgcataacttaagaggctcattaaattacactgtaaatacagtgggccctacatattcacagattccaaatccacagactgaaccaactgcagatcagaaacattggaaaaaaattaaaaataaaaaataacaatacaacaattaaaaataatgcaaattttaaaaatgatatattataacaactatttacatagcatttacattttataggtataataagtaatctagagatgatttaagctctatatgggaggatgtgtataggctatgtgaaattaaataattcaaatttaaatctattggaactttatattattctgagccttgacaggaatgtagctatgtagcccgagtcacatggcatatgcagctgcaacttctgactttttttcctgtaaatattaataattaggaaggccacatgacaacagagataagattcccttagatctttacccctcctcattgagtaataaagtaaacttccttggaatatagcaatctgtaaccaaacaaatcattgtaattggtcttatatggaaaatgctttaactctgccaaaacttctctggctttgtctatatacttcaggtatatgcaaatactatgccattttatataaaggacttgagcatccatgattttggtatccatggagggtcctgaataccagaatgtgactgtattttgagataaggcctttaaaaaggtaattacattaaaatgaggccatcagggtggaccctaatccaatacgaccgctgtccttataagaagagaaaatttgaacacacagagtcaccaggaatgtgtgtacacagaggaaaaaccatgtgaggatacagctaaaaggtgactgtgtgcaagctaaggctttggaagaaaccaaacttgttgactcctttatcttagactcctagcctccagaactgtgaagataaaaatttctgctgtttaagccacccagtctgagttcttttattatggccatctagcatactaatacacctcccctaaaaaaaggcaaaagactttaacagatacttcactaaaaaaagatctatggaaagcaaataagcacatgaaaagattattaacatagtcattagggaagtacaaattaaaaccacaatgagataccactaaattcttgtaagagtagctaaaattaaaaacattttttaaaagtcttactacaaaatgcctgtgaggatacagagcaactgaaactcttattcattgctgctgggaatgcaaaaaggtacagccactctgaaaaacattctggcaatttcttataaagttaattatatgctaccatatgacctagaaatcctactcctggatatttatccaagtaaaatgaaaacttacattcatgtaaaaatcagagcatgattatttatggcagcttttttcatcataatcaaaaattgcaaacaactcaaatatccttcagctaatgaatagaaaagcaaattgtgacacagccatatattaaactattcagccataaaaataaataaactactgatacaaacaactggatgaatcctaaacgcattatgctaagtgaaagaagccacacacaaacagccacattattacatgattccatttatgtaacattctgaaaaaagacaaaactacaaggatagcagacaaagcaatcattgccagatatcaggaagaggagttaaccacaagggacagaagtgaattttgtgggtggtagaactgttccatatttttattgtggtggtagatacacaactgtatgcattttcaaaactcatagacctgtataaaacaaacagttaattttgctgtatgcaaattatacctcaaaaaaatctgtcataaaaaaattcctacctatggcttcctccttcaaaaaacacagcatacctaggaagaaggtagggaagatgatgggtttaaaataccaaattaccaaagactatatccctatagtacttcagtgaatataaataatttaaattaaaaagcatggatatatagaggtatttaatttttaagattccagtcaaaaacaacaaaaaacgttaacttccaatattagaaatagtcacttatctgaaactcttaatttcaaagatttctgtaattttgattattcattatcatgactttatattcattatcatgagttactgaatggtgaaagttcaataaatacagatgaaagcaatgaataaaagcttccattggattttcaaagatcagaagaagtttggatttaatctgaatggaggtaagaaatcactatcgtttctttagaatgagggaacatgacaaaatattatgttaggaaaattagtctagtaatcatatatgagattgagttgaaggaaaatattaaagcaaagatatagaagatagctgcagtgatgaagagggccggggccaggatgatagccagaggattgtaatcattatattcaaaatgtgtatcttttccatatttaactgaatacccagaaatgatgtcacatttgctacacaaagttcatttgaaattgaggctcaggtggcaacttggcctataaaatttaaacccgcgagtgcacttgctcacccagactgcagcctgagtcgtccccacccacccttcctatgcagaaaccgtggtacagcgcagaaaccgtggtactgctccatgcccaggcagatctccaggcactaaagcacctgctcacctggattgacagcctgagccatcccattagtcctgtgcaaaaatccagccatcagggggcactctctgctggttcagcagccagagacacccactgttcttatgcagagagagtggtgcagtgggtccctctccaccccactcccagacagatctccaggcagtcggagcacccactcctccagcctgagctaccccacccttcctgcacaaagatcatggtgcagcaaggccctttccaatccatacccaggcatatctccaggcattgaagcacttgcttgcctggaacagcagcctgagctgccccacccttcctgcaaagagatcgtagtgcatctgagccttctttgcaccatgccgattaaacttcagatctccaggtgtttggagaacccactcacccagatcaacagcctgagccaccctacacttcctgtgcatagatcgtggtatagtggggccctatgtactccatacccctgcatatctccaggcattcaaagcacttgctcacacagagttacagcctgagccaccccaccctcctgtgcagagtttcaggtacaggggagcgcctctccactccaccctcaagcagatctccaggcattcagagtacctgctcacctactcagcatcctgagccgcctcagccttgctgtgcagagattatgatgaagtagggccctctctgtcccatgcccagcgatacctccaggcagtcagagcacctgttaatctgatttaacagcctgagctgcccaacccttcctgtgcagagactgtgtggtgcagcagggccctttacactccacacccaggcagatctcaaggaatctagaacactcactttcctggactaagagtttaggctgctccctctctccctgtgcagacaacttggatccaaggaggtttccatctcaacacctaggcacacctctcggtggatgctcactacattctccctcagtccagatgtttgtacctgccatcaggaaacctgtaggtgggcctaccccgtatggccccacccatcttgctcccaccccacccccgggggcaaagcagggagctcagaccactgtgcactccatgaattagcccactgcctgaagcaacagagagcttctcccagtaaacaatgatcaaatatatacccagctgcactgaccatagccagcttgtaggtcaaactgcacagcccaatataaaacctgcatagcccaatacaaaacctgccagtaaagtgcagccctatagtgcgtagggctataacagaaaagccaaaagactacccatcattgtctacagtcacacttcctaagaagcggggaaagggaaagggagagaaaacaatattacaaggaaagaaagcaaagaaaatatcctccctgcaagaaaataattacaaaaattagaagtaccagtgactacagatgagaaggaaccagctaaagaattctggcacctgaaaaacctggatgaagcaacaccactaaaagatcacactagctctccagcaatgatacctaaccaaaatggaaacatagaagttacagataaaaaattcaaagcacgaactgcaaataagctcaatgagatggaagacaaagttgaaaatcaacacaaagaaactgctaaagcaatgcaggacatgaggaaagagataaacatcttaaaaataaatcagtcagagcttctggaattgaaaacttgcttaagaaatttcaaaatacagttgaaagctttatcaattgccaagatcaacatgaagaaagaatttcagagcttgaagataggtctttttgaattaactcaatcagacaaaaataagaaaaaactatttttaaaaatgaacaaagtcattgagaattagggaattatgtaaagtgaccaaaaccatgaattatcaaaatttctgtgagaggagaaaaagtaaacaacctggaaagcatatttgagagaatacttcaagaatatttgcctaatcatgctagagagctagacatctctagcaagatgtatagtccggtgactactcaaggtcaatgttataaaaaaaatcttaagggcagctgggaaaaaacatcagatcacataaaggggaatcccatcaggctaacagcagacttctcagcagaaaatttgtaagccaggagagattgggagctcattttcagcattctaaaaagaaatttcaaccaagaatttcatatcccactaaattaatcttcataagtgaaagaaaaaataaaatcttgtccagacaagcaagcactaagggaattcattaccactagaggagcctaacaagagatccttaagggagtcttaaacatggaaatgaaagaacaataactgctaccacaaaaacatacttaaataaatagctcacagaacccataaagcaatcacacaatagaaactacaaaacagccaggtaacaactttgataggatcaaaacctcatatatcaatattaaccttgaatgtaaacagtctaaacacccccacttaaaaggcacaaattggcaagttgaattaaaaaaaaaaaaacaagacctatcgctcacacacacataatgacacccataggctaccaagtaatgagttgggaaaagatctatcatgtaaacagaaaacaaaaaaacggcgggagttggtattcttttatcagataaaaccaactacagtaaaagaagacaaagaaggttattacacaacgataaaaggtttgattcaacaagacttaaatatcctaaatatatacagactcaacagtagagcacctagatttatagaacaagtacttctagacctaccaaaagacttagccacataataatagtgagggacttcaacatcgcactgacaaaattaggcagatcactgaggcaccaactaagaaattctggacttgagattgacacttgaccaattggatttaatatacatctacagaatattccactcaacagccagagaatatataatacattcttttcacctgtacatggaacatactctgagattgaccacatgctcagcaataaatcaagtctcaataagttcaaaaaaatgaaaatcataccaaccatactctcagggcacagtggaataaaaatagaaattaataccaaggagacctctcaaaaccacacaagtatattaaaattaaacaacttgcttctaaatgacttttgggtaaacaacaaaattaaggcagaagtaaaaaaattatttaataaaaacagagacacaacatccaaaattttggggatgcagcaaaagcaatgttaatttataatactaaatgcctacatcaggaatttagagagatcttaaattaaccatctaacatgacacctagaggaactggaaaaacaggaacaaactaaccccaaagctagctgaatgaaagaaataaccaaaatcaaagcagaactaaatgaaattgaaaccccaaaatacatacaaaggatcagtgaaaccaaaagttggttttttgcaaggatagacaagatcaatagaccactagctagattaacaaagaaaaaaagaaagaagatccaaataagtgcaatccaaaatgacaaagatgacattactaccaatcccacagaaatacaaaagatcctcagagactattatgaacacctcaatgcacataaactagaaaatctaaaggaaatggataaatttctggaaacaacctaccaagattgaatcgggaagagattgaaaccctggacagaccaataacaagttccaaaattgaaccagtaatacaaagcccaccaaccaaaaaaaaaagccctggaccagaagaatttacagtcaaaattccaccagatgtacaaagaagagtttatagcaatcctactgaaactattctaaaaaactgaggagaagggataggactcctttctaactcatgctacaaaagtagcatcagcctgacaccaaaacctggcaaagacacaaaaagataagaaaactacaggccaatatccctgatgaacacagatgtaaaaatccgcaacacaattgctaggaacaggcctcaagcctggccataaacaggccatgagaaacaagccataaacaaaatctctgcagccctgtgactgcagagatttcttgctgctatgatggcttgatggctatgatgcccatgctggaagttgccggtttaccagaatgaggacaaggaacacctggcccacccagggcagaaaactgctcaaggcgttcctaaaccacaaacaatagcatgagcaatctgtgccttaagaacatgttcctgctgcagataacaagccagagcctgtccctttgtttcctgtaaggaatgcttttagctaatctataacctatagaaacaatgcttatcactggcttattgtcagtaaataggtgggtcaaactctgtttgaggctctcagctctgaaggctgttagctccctgattcccactttgtactctatttctgtgtctttgtcttaattcctctaacgccgctgggttggggtctccatgaccaagctggtcttggcaacgatactagcaaactgaatccagtagcacatcaaaaagttaattcaccataatcatgtaagctttattctagggacgcaacgttggttcaacatacacaaaaaaataaaactaggcctagtttgttaggagttttttatcatgaagcagtgttagattttattaaaaggtttttctgtgtccatcaagatgatcatatggttttggttttaattctttttatgtggtgaatcacattttttttgtacatgttgaaggaagagacctcaaaataataagaaccatctatgataaacccatagccaacatcatactgaatgagcaaaagctggaagcactcccctggagagctgaaacaagacaaagatgcccactctcactactcatcttcagcatagtactggaagttctagctgcaacaatgaggcaagagaaagaaataaaatgcatccacataggaaaaaaagaattcaaatgatctctcttcactgacaatatgattctgtatctagaaaaccctaaagactctatctaaaggctcctgaaacagataaacaacttcagtaaagtgtcaggatacaaaatcaaagtacaaaaatcagtagcagttctatataccaataatgttcaagctgagagtcaaatcaagaatgcaatcacatttacaactgccccaccccaccaaaagaaaagcaaaaaacataggtatacatctaaccaaggaggtgaaagaaagatctctacaaggagaactacaaaacactgctcattgtagattctggatattagccctttgtcagatgagtaggttgtgaaaattttctcccattttgtaggttgcctgttcactctgatggtagtttttttgctgtgcagaagctctttagtttacttagatcccatttgtcaattttggcttttgttgtcattgcttttggtgttttagacatgaagtccttgcccatgcctatgtcctgaatggtaatgcctaggttttcttctagggtttttatggttttaggtctaatgtttaagtctttaatccatcgtgaattgatttttgtataaggtgtaaggaagggatccagtttcagctttctccatatggctagccagttttcccagcaccatttattaaatagggaatcctttccccattgcttgtttttctcaggtttgtcaaagatcagatagttgtagatatacggctttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcggcctcttttttggttccatatgaactttaaagtagttttttccaattctgtgaagaaagtcattggtagcttgatggggatggcattgaatctataaattaccttgggcagtgtggccattttcacgatattgattcttcctacccatgagcatggaatgttcttccatttgtttgtatcctcttttatttcattgagcagtggtttgtagttctccttgaagaggtccttcacgtcccttgtaaggtggattcctaggtattttattctctttgaagcaattgtgaatgggagttcactcatgatttggctctctgtttgtctgttattggtgtataagaatgcttgcgatttttgtacattgattttgtatcctgagattttgctgaagttgcttatcagcttaaggatattttgggctgagacaatggggtttctacatatacaatcatgtcatctgcaaacagggacaatttgacttcctcttttcctaattgaataccctttatttccttctcctgcctgattgccctggccagaatttccaacactatattgaatagaagtggtgagagagggcatccctgtcttgtgccagttttcaaagggaatgcttccagtttttgcccattcagtatggtattggctgtgggtttgtcatagatagctcttactattttgagatacgtcccatcaataaacaaccccatcaaaaagtgggcgaaggatatgaacagacacttctcaaaagaagacatttatgtagccaaaaaacacacgaaaaaatgctcaccatcactggccatcagagaaatgcaaatcaaaaccacaatgagataccatctcacaccagttagaatggcaatcattaaaaggtcaggacacaacaggtgctggagaggatgtggagaaataggaacacttttacactgttggtgggactgtaaactagttcaaccactgtggaagtcagtgtggagattcctcagggatctagaactagaaataccatttgacccagccatcccattactgggtatatacccaaaggattataaatcatgctgctataaagacacatgcacacatatgtttattgcggcactcttcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcacaaggacaaaaaaccaaacaccgcatgttctcactcataggtgggaattgaacccatggacacaggaaggggaacatcacactctggggactgttgtggggtggcgggaggggggaggaatagcattaggagatatacctaatgctaaatgacgagttaatgggtgcagcacaccagcatggcacatgtatacatatgtaactaacctgcacattgtgcacatgtaccctaaaacttaaagtataataataaaaaaataaaaattaaaaaaaaaaacaaaaaaaaaacaaaacactgctcaaagaaatcagagacaacacaaacaaatgggaaaacattccatgctcatggataggaagaaatcaatattattgaaatggccatactgcccaaagcaatctacagattcaacaatattcctatcaaactgccaatgacatttttcacaggattagaaaaagagtattctaaagttcaaatggaaccaaaaaaagaatttgaataggcaaaacaatcctaagcaaatagaataaagccagaggcatcacattacccaacttcaaactatactctaaggctacagtaaccaaaagggcatggtatttgtacaaaaacagtcacatagaccaatgtaacagaatagagagcccagaatcaaagctacacacctacatccatttgacaaagtttacaaaaacaagcaatggggaaaggactccctattcaataaatagtgctgggacagctgactagtcatatgcagaagaatgaaaccagacacttatctttaaccacatataaaaattaactcaaaatggattaaatatttaaatgtaagacctcaaactataggatttcctaggaaacaccattctggacattgactttgggaaataatttatcactaaatcctcaaaaccatttaccaaaaaaaaagtgagaagtgggatctaattaaacagaagagcttctgcaaaggaaattatcaacagagcagacagacaatctacagaatgggagaaaatattcacaagctaggcatctgacaaaggtctaatagctagaatttataagaaacttaaacaattagataagcaaaaaccaaataaccccattaaaaagtgagcaaaggacatgaacagacacttctcaaaagaagacatacaggtggccaacaaacatatgaaacaatgctccacatcactattcatcagataatgcaaaataaaaccacaatgggacaccacctcacagaatggctattatgaaaaatgaatggctattatgaaaaagtcaaaaaaacaacagatgctggcaaggctatggagaaaaaggggatgcttatatattgttggtaggaatgtaaattagttcaacccctgtggaaaggagtttggagatttctgaaagaacttaaaacaggactatcatctggcccagcaatcccactactgagtatataaccaaaagaaaataaatcattctaccaaaaagacacatgcactcatatgttcatcacagcaccattcacaatagcaaagacatggaatcaacatagatgcccatcagtggtggactggataaagaagacacagtacatatagaccatggaatactatgcagccataaaaaagattgaagttgtgtcctctgcagcaacatggatgcagctggaggccattatcttatgcaagttaacacagaaacagaaaaccaaataccacacgttctcatttataagtgggagctaaacattggatactcatgggcataaggatagcaacaagctttcttggggactagtagaggtggggacattgggaactactagaggttagaggaagaagaggagtaatagctgaaaaactacctattgtgtactatgcccactacctgggtcacaggatgaatcttagcccaaaccttagcagcttgcaatataaccatgtacatgtacaaacctgcacatgtaccccttgattctaaaattaaaattaaaacagaaagaaagataaaaacctccctagtgactatgctgacccatttaaggtcacagcaagagcagcagtacccaagttaggtggtgataacacagtggaagttagacccagtgatgatagaaattaaacccaattttactttctcatccttggctttttgttttctactagtaacaagtgttaatctcccctttgaacaggagtatgtggcttcactgcagcactttcagtcagagacagaggctaacggcatacctagccaaagcacaagaaacctaaaaggcctcagctttggtctgattccactcagaaaagctttccttcaaataagtcaactagacgtctcttccttttaaagccaacagtgatcatctgataggaaacacttctttgttggttttcttttgtttcagtgaaattcatattttccctacagggatataaataatgccgtatcttctgctatttaaaaattcctaattagaagccttttatgttataaagctgctaaaaagcaacccaaacctaagggaattttaaaagataagttattggtgacatagatgttacaacttaagctatgaagtcaaaagtgttgattgatgaggcacagaaggagtcttgttcacactcattcacctgtttcatttttgagactgtccatgccctgggaacaagaatctactttagccagaaatacataggcgtgctggatgaagttgaagtttgcctccagaattaaggtctttttgtatatgtcacctcatatctgataaacagaccacttatctggattctgatcttcaccatcttcttttactatatgggttcatgaccctccacccttcacctagtactcaattccaatagatcttctagttcttgatagtctagatatttaaccactacttttgcttcactgtgtcttcctaattcctgtatttttgcttcatttcttacctgtgactttcacatctagtatttgtatctacattcaatttctgcttccctaccatactttggtaggtccccaagtttaacctctatgtgcctcagttttctcattcatagaatgagaaaaacagtaagattattgtaaaagtatttcaaggattacaggaaataataagtaaagtgattagcataacctgagatagagaaagtgccaaataactgctagctgcactcaagcatatttatgcctgaataagagctttgtcctctgattttgttctacatttgtggaaatagataatagccatttgctaccttaagagaaattcctttgttttatatatgaagaattattctcttcttacctttctcttctaagggttaagtaaattcattttctttctaatgaatcatgttttctcacactttagtcattttactactttcttccaaggtctccaatcttattttagttgtagaaaaaaatacaaatctccagtaatattgataccaatccaaaaagtatttaactaaacctatcatcccaaatgattacctggcacccccagccatgatgaggccccatcagtgtcccaggcaatgctccccattctgcccaatgcttcagaggaaccaagatgctactgactgcactaagcaccaaagagccactccagcacttggatccaggaagaaatagcaacaccaaaaaagcctgcgaaagtgtcagttttctgtgcatagttcagttaacagctagataacaccaatcatccaaggcataactgttataggttttgacagtaagacatcccccttggcaaaaaatgtctcctccactggctgccaaggctcctgatcatcctaggatcacctcctgtgtgttgattaagcttttgctggctgagacgcagctggcctttacagcaggaaacccacggaagagtgtgtacgtgtgtgtcctctctcaacttctggctgagtcactcaaatcaaatagtcactgaaacataaagggggttccctacacctaattttggtggtaggggaaaaaatgtaaaatcatctggggcaatcaaggactattttcaggaacatttgtctttaaaatctaaaattaagccacctcacaacctgggtggttccccatggaggaaaagaggatgagctctgaaaagctagagttgtaacctgtatccttgggaacacggctataggcagtgtgaagagctgtacatataactgataaagggtccagcaggttgtcccattcctgcaggaagagcagagccccaaatcccatttcaacctgctttagcactcacacacctcaccaagacagtggtgactgccagcttctctcttgaccttcctcacccctaggtaccacaggatgtctaatgggaaggcacaagagcataaaacttgttgctctcagagttctatggatgaggaaactctgaaatatgaggacagatgtgagagaatctctagaaaccttaagcttaggacagaaggaggagagcatcccgctcacactgtctaacaatttaatagggattcatgcatctaagtatgtttgtgagggaggtagatgttaagaaatcatacatacagaacctcgttgagtttcgaaattggaggttcttgggcaacaagggacagcatggggtaacagactgtttggggaggagaggaagggaaagacaggaaatgaaaaattaagcacctggctagaacagtacagggatacaaggatggtatttgggaaatataccaaaataattaacttttgaaagcaagaaatgaagacattgaaaggaaataaatggctctccaagaaccagaaagacaagtatgaaatgggcaagactctatgggtcagagatcccttgcatcagctgatttctttcttctttttgagacggagttttgctcttgttgcccaggctggagtgtagtggcgcaatcttggctcactgcaacctcggcctcccaggttcaagtgattttcctgcctcagccccctgagtagctggaattacaggcacatgccaccaagctcagctaattttttgtatttttagtagagatggggtttcatcatgttggccaggctgttctcaaactcctgacctcaggtaatccacccacctcggcctcccaaagtgcagggattacaggtgtgagccaaagtgcccggcctcttttttttttttttttgagacaaagtcccttctgtcacctaggctggagtgcaatggcacgatctcagctcactgcaacctccggctcccaggctcaagcaattctcctgtctcagcctcctgagtagctgggactacaggcgcatgccaccgtgtccagctaatttttgtatttttagtagagacagggttttgccatgttacccaggctggtcatcgcatctggctaattcttgtatttttagtagagatgtggtttcgccatgttgcccaggctggtctcgaactcctgagctcaggtgattcgccagcctcagcctcccaaagtactgggattataggcatgagccaccacgcccagatggatcagctgatttttttatagtacttgattatttttccctaacatgtatcagtacagctagtatcacataggtaaaaaaccaaactaaattcctttttatagaacaattatttctatatccctgttaatgtatcttttacagatttccctgggagtcttttctttatgtacctaagatttaaatttcacttgcagtagtaaattatttaaactcaattcaaaatgaaatgtgttttcatttaattatcggaaatgcatttcataatgccaagtgctggttaaaagtaagtaatttcccccattcctcacccaagccacctctgcaccaccacccacaaaaacaaattagtctttttggttgagaaaaatgaatcattacttctcaacctaagttgcaacttgtcatttttcatttgagcatgtattcactagaagcaggtgctctttgctcttttgacagtaaccaaacatttaagcgtggaaagagaccaagaaaagcaccttggcccaccttctcaggggcttagataagtatctggaaaaaaatcaatatcatggaaatgaagtgccaaattgttttaaaactgcttagctctcactattgctcctaggactgaatgcaacaaaaccaattagcaggcattcactgaggcaggaaatagagtggaaagaaagggtagaaatggagaaaatgaggaaataaaaatatattaaatttatatatacttaagtatatttataatacatgattttatatatatatatatatacacacattaggtgtgtgtatatacatatattcattcattcatttaaattttggacatgttgagcttgaaaagcccattaagtaactagataaagttgctttgggttccacatttaagtgagatcatgtaatatttgtctttttgtatctaggtcatttcattcctcttgaaaagaaaactcatcacaggtatctttaacacaaagcaccaatcttaatgtaattttattctcatgtattttcccactggtcataaattttgaaggccctaatttgctttccattgcccatgttctaatctgaattcatccaagagtgaaactgatgcgaaatctcatcttctatttctcttaatgttaagcactttgtttcttaaattgatgctgtagacaatttatgtagccaaacagaaatgtcacaacaattttgggaaacatctcaagttatttgtttcaaagaaagaaaataaattattttaccaagagataagtgaaaacattgtttttcaatccctttaaacatttatgatcgaattctggatagccaaggtgatggcagctgcttaagtctgaatctcccagcacatactccaaaaataaaaataaaaaataaataaaactacagaaaacctatgctgtcagcataactagaaaagagagaacaacctagatttcaaattacacgtgaataaaaaattaacaccaactcttagcatggaatttctcacccttctggtgcaagcctacctggggaacaagggcaagatggggccagagtggagggatggtgggagatgggggagaaccatactgaaaacagaagagagaacctagcaatgaaatttaaaattgatctaaaatcacagctataaagagaaattctactctcattgcaaaaataatggaaaaagagtcctggtagatcagagcctactagaaggaggaatgagtatgtggggctctaagaggtggtcttagaaaggccttgggagagagaagggtaacaaaggaatggagaagcactctggaaactacacagtgaacataagaagaaataagaaagggaaaatcagaatccagtaagacaaaagaatttttcttaattgaagaaagctactgaggaaataaactatcttttacaaccttaacagaagagttctaaccagggatcttgtaaaccatcccaaaccatcacagaattgctgaggcttaagcaacctacaagtattctaaaaagaaaaaaaaactaatatgacaggaaaacagaaataaaaattttaaaaactcagttgaaaatatcccctcaaaaaaaccaatagtgaatcaaaataaaatagtagcataatatcccaaagtgaatcaaacagcctcaaaagattatgaagactttcaccaaaattacagacagatatagatagaaataagaatatagatatacacaaaactgtgcaaccatagttcatttggcaaccatttattaaaacattaaaaatcaactttgtccctggcactgtcctagttgttggggaatagagaggaaacattctctatgacttcaaggagcttattacagtagaaggagaaacacatacagtatgacaagtgatgggataaaagtatacaggaaatcctttcgaaacaccataaagtagtatctacctccaaattaggagccatcacatatgcaactgaagtacaagtaagagccagatcagaaaattccaggaggaaaataatcatgcagctgtaacagtatatgcaaaggcatgaagtcagaagaaatgtgatgtattcaaagaacggaaaatactctgatatggctgaaaacaaagctctgggaaaataaagggtcacagttgctttatacaatttagatttcattctaaaggcaacagagaaccagaaccattgaaggatttttacttgaggatatgttcagattttcattttaaaataatccttccagtaataatatttaggctgaattagaaaggggtgaatttgaatgcaagataaccagttagcaggcattcaccaacaaggaatataagtggaaaaaaagtataggaatggaggaaagaaaagataatatattaaatgtatataaaaatgtatttacaatatatgatatataatacgtttaaattttggacatcttgagcttgaacacctcattaagtaactggataaaatcttgaattgaagagaaatatatggggtagaaataaagatatgggaatcatccaattgttagattaaaggcagttattgactccgtgggtgtatatgattttactctatagagtatacagagggtgtaggggaaagaaagaaaaatgagaaggagagaaaaggaagagcaagttatgttctgggcaatatcaacatttactctgacaggaactgggaagagtccagacatgtaggagaaaaattgggagaaaaaaaaagaaaattaagatttacaggaaaaaagaacagttgaagttaaaaggtctgaaaaatgtcagttggataagtgatcataataacagtgtttgtgcaagtgaaaggcagaaatagattactgagaagtgaaaagtcaagttaataaaaaatagtatatacaaacctctccttagaaatgtttgacttctgactcacttgtatacttaacctttcatatcattcatttctccaacaagtgtttattgagtgccacttaatatcaagagagacaatgtgcttatgtcccaatggagaagccaggcaataaacaacttaaagatcaaatgtgcaagataatttcctacagtgataactgctatgaagaggcgaaagtctacattagattaatcagagaaatccactgtaaggaagtgatacttaagctgaaccctgaatgataagaaggaattgtcctgtgagctctaggggaaaatcattccacgaagagggaacagcaagtactaaggacagattagcaagcacataattaaaacatccacagtaataactatactgatacttacatccacccaacaactgctaataaaaccatgccttcactgagtctgctggcagggctgttgagctggtcacaaggaggcaaataagctggctcatattgaaataagagaggaaggaatcatagaaaaagaaaagaccatggaaacctcccctcctctacaattaacaattttaaactgttgggagtatttcatgttcattgaatgaacaaaaatgttaataatagattgccctaaatcttgaattttagctgcattttgaagatccttgaagcaataaaaatgcctgtgctttttaaaggtagttttgttttgtttttttaaaaggcgggggttgcctttcaggccagatttctttgatttcctgtttcagaagcttcacctagctcaacgtgggggaaaaaaaaaaaaaagctcgcaaaaggaatatttgtacagcatagcttttatgttaagagtttgattttaggccggacacggcggctcacccctgtaatcccagcacttgggaggccgaggcgggtggatcatgaggtcagggaatcgagaccatcctggctaacatggtgaaaccccgtctctactaaaaaatacaaaaaattagctgggcgtggtggcacgcacctgtagtcccagctactcgggaggctgaggcaggggaatggcgtgaacccgggaggcggagcttgcagtgagcagagatcgcaccactgcactccaggctgggtgacagagcgagactctgtctcaaaaaaaaaaaaaaaagtttgattttatatgcttaacatgtattttttaaggtatatattaacatttctttttaattattttcatgattaactggaatttttgtggcatctgatacttaatggaaatagaacaccagttaacaaaactagctccaggaaacattcgactccctcgcttctgtccaaaaatggatgtagttagtaagcaggtcagcgcacctaaaatctttcagaaacttagcatgaggaaaagaagaaagacaggactgtcgctggatggggtattgctttgaaagaaggttaccattgctgctgctgttgttgccagcatcgtcatgtcgtttggatcaaactttaacaggttaatatgctgaaaaggaaaaatgagtagaaaaaaatgaaaagttgacagtaaaggcaaaatacaacttcctataaaggaaggtcctcaggggacagaagaaaatgggattcagaatacaggattattctgggcacaagagaaaactaagtttaaggatagcatactttttgtgactctgggatctcaaaatagatgctgaaacccagctatccaaaccagatgaaatgcttcatacaatcactatggattccactgaagaagaaaactgagggtttttttaattgctttataatttgaaagttgctgataattagagctatttaactcagcacaacattcttctaaatggcatcattgtgtcactgtactattttggttaaactcccactggtttaatttcagaaacatcctttgaataaaatgccaagttaaaaagaagtaatatctcattatttctttaaaataattcaattaatttcaaaaggatgtttcctgggaaagacttgtaaggtttcttttgtaggcctgaccataacacaagagtacattatagaaaatagcagcagctacctaccagtcagtttttaagagcacctttctttacacaataaatatgttcctgaggagctttttaaattttgaatgtgtattgtggaggctatttggacctgcaaaaacctgatgctgccatttactatttgtgtgttctagaacaagctactaaataggttaccctctcgaaattttctagggattaaatattttccattctatttggcctaattgggctgcctcagaaagacagactaacccatcaagaattaagaattacttcttgaactgagaattacttcttctatgaaatgtaatattaacacctgttgtggggcacccacctgttgtcaaacttcaaagatggataaagcacaggatagtttgattccttcactggctcagggcaccaaagagttgtgttgccagatttagcaaataaaacattcccagttaaatttcactttcaaaaagaataaatatttttattagcataagtgtgccccatgcaatatttgagacataattctactagaaaattattcatcattgatatgaaattcaaatttaactgggcattctgtattattttatctggcaaccctaaccaaagcaacagcttgtctcccacctggctatggcagaagtggaatacaaaagtcaaagtacatgataaagtgctgtacccacacacaccgccatctaaacctctgtatacttccaaaattacaatgtttcctgactgaggcctgcttcccctgctctcctccatgtgatcaagctccctgacaccctctctccactgacttctacccacactctggacctaagacaaaatttctgatgcccctacacactatcccagaactaaaaagactccaaggttacaacatggcagaaacattctctccgtttccctaagactcctagaagcattttttagagtcataggtccatacagggcctgagattcactggccatctcagatctcccaaatttcattgcagtaaattctatcatgtctcctaccctggaggaatgggcgggtagtggcagacagtagtggtagaccagcacaaaaacaaaccatgtctaagtttattctattcctatccaactctcctcttctccccaagttggagggtatttgctcaggaggcacagaagaggtgacatggaagaggcagtataacaacttggttatgcctattgtctctcattccaaaatatcaagaatttgccattttttattacttaggcctgatttgaaacttacatcctgtgtgagtggcccaataggggagaaaattgatattcccattatatgggaattataaggggaaaataatattcccattatatgattattgtaagaattaagtaaatcaaagacctaacctgtatagtaggcacttccacagcttcagagatggaaaatctgtattactaaataatgtccagtaggcactatctcctaacattccaacctctctgtcaataattcataaatgaatattcacatgctctaaaagttcctgttattatgtgaataatcatcacatattttctgtgaaagtgaaatgctgtgtagtatatttcttatatcgagcaccctagtagaaagtatttacataatgcgggaagagtctaccttctttccataaattgactttctttataattgtattattttttacaacccttctaaaacaaaatgatatccatgcataaagaacacagctttcatcttgcggtgtgacagactcctatgtgcctttttatttttaatagactggcctcacacactggtgggggttgtattcatgaatatatggcttatgtttacggttaggagaaagataggtttaaaaataataataaaggactttctgcctttactgaagccacgttcccagcctttcataatttactacactatctcattattttttaatgcacttgcctttttaaaaaaaatccaaaccttccaaattgttgcatgataatttttcttccttttcaacaggaggttctcacccctctgttgtctactccagcactggcccaagagaacctcttgtacaacccagttttaaagaatgattaagaaggatttcatataggtaactgaatatgaaattagttataattttgagagcatggttatctcatatgaataaaattttaattgcttataacattaaataatgaaataaatttgtagcgctgtcctaattccatcaattttggaatacagttcaaaatgagatgtagcaagtaagaaatacaaattgtatttctcattaataatcataagccatatataatatctgttgtctataattccaatgataaacacttactgttttcagagaagttctaggtaatacacactcaaccttctataagctatcttaacttttttatttttctggcataaactatgtgtctatctttttttaaaaaaattacactttaagttctgggatatatgtgcagaaagtgcaggtttgttaaataggtatacacgtgccatggtggtttgctgcacccttcaacccgtcatctacattaggtatttctcctaatgctatccctcccctaggcccccacccactgacaggccctggtgtgtgatgttcccctccctgtgcccatgtattctcattgttcaattcctacttaggagtgacaacatgcagtgtttggttttctatccctgtaatagtttgctgagaataatggtttccagcttcatccatgtccctccaaaggacgtgaactcatccttttttatggctgcatagtgttccatggtatatatgtgccacattttctttatccagtctatcattgataggcatttgggttaattaccagtctttgctattgtgaacagtgctcccataaacatatgtgtgcatgtgtctttatagtagaatgatttataatcctttgggtatatacctagtaatgggattgctgggtccaatggtatttctggttctacatccttgaggaattgccacactgtcttccacaatggttgaactagtttacatacccatcaacagtgtaaaagccttcctatttctccacgtcctctccagcatctgttgtttcctaactttttaaagatagccattctaactggcgtgagatggtatctcattgtggttttgatttgcacttctctaatgaccactgatgatgagcttttttgaatgtgtttcttggccgcataaatgtcttcttttgagaaatatctgttcatatccttcacccacgttttgatggggttgtttgtttgtttcttgtaaatttgtttaagttccttatagattctggatgttggccctttgtcagatggataggttgcaaaaatcttctcccattcagtgggttgcctgttcactctgataatagtttcttttgctgtgcagaagctctttagttcaaattagatcccatttgtcaattttggcttttgttgccattgctttgggtgtttcagtcacaaagtccttgcccatgcctatgtcctgaatggtattgcctaggttttcttctagggtttctatggttttaggtctaacacttaagtctttaatccatcttgaattaatttttgtataaggtgtaaggaaggggtccagtttcagttttatgcatatggctagccagttttcccaacaccatttattaaatataaaatcttttccccattgcttgtttttgtcaggtttgtcaagatcagatggttgtagatgtgtggtgttatttctaaggcctctgttctgttccattggtctatatatctgttttggtaccagtaccatgctgttttggttactgcagccttgtagtatagtttgaagtcaggtagtgtggtgcttccagctttgttctttttgcttagaattgtcttggctatgcaagctcttttttggttctgtatgaaatttaaagtcgttttttctaattctgtgaggaaagtcagtggtagcttgatggggatggcattgaatctataaattactttgggcataatggccattttcatgatattgatttctcctatccaagagcacgaaatgtttttccatttgtttgtgtcctctcttatttccttgagcagtggtttgtagctctccttgaagaggtccttcacatcccttgtaagttttattcctaggtattttattcactttgtagaaattgtgaatgggagttcactcatgatttgggtctctgtttgcctattattggcatataggaatgcttgtgatttttgcgcattgattttgtatcctgagactttgctgaagttgcttatcagcttaaggagattttgacctgagacaatggggttttctaaatatacaatcatgtcatctgcaaacagagacaatttgacttcctctcttcctatttgaatatgctttatttctttctcttgcctgattgccctggccagaacttccaatactctgttgaataggagtggtgagagagggcatccttgtcttgtgccagttttcaaagggaatgcttccggtttttgtccattcagtgtgatgttggctgtgggtttgtcataaatagctcttactattttgagatacgttccatcaatacctagtttattgagagttattagcatgaagcggtgttgaattttgttgaaggccttttctgcatctattgagatattcatgggttttgtcgttggttctgtttaggtgatgaattacgtttattgatttgcatatgttgaaccagccttgcatcccaggtatgaagccgacttgatcatggtggataagctttttgatgtgctgctggattcggtttgccagtcttttattgaggatttttgcattgatattcatcagggatattggccccaaattttcttttttgttgtgtctctgccaggttttggtatcaggatgatgttggcctcataaaatgagttagggaggagtccctcattttctattgtttggaatagtttcagaaggaatggtaccacctcctctttggacctctggtagaattcagctgtgaatccgtctggtcctgggctttttttggttggtaggctattaattactgtctcaatttcagaacttgttattggtgtattcagggattcgacttcttcctggtttagtcttgggagggcgtatgtgttgaggaatttatccatttcttcgagattttctagtttatttgtgtagaggggtttatagtattctctgatggtagtttgtatttctgtgggatcggtggtgatatccctttatcattttttattgtgtctatttgattcttctctcttttcttctttattagtctggctagaagtctatctattttgttaatcttttcaaaaaaccaactcctggattcattgatttttggaagggtttttcatatctctatctccttcagttccgctctgatcttagttatttcttgtcttctgctagcttttgagtttgtttgctcttgcttctctagttcttttaattgtgacgttagggtgtcaattttagatctttcccactttctcctgtgggcatttagtgctataaatttccctgtacacaccactttagctgtgtcccagggattcttgtatgttgtgtctttgttctcattggtttcaaagaatttatttatttctgccttactttggttatttacccagtagtcattcaggagcaggtttttcagtttcctcgtagttgtgcagttgagtgaatctcttaaacctgagttctaatttgattgcactatagtctgagagactgtttgttaagatttctgttctcttgcatttgctaaggagtgttttacttccaattatgtggtcaattttagaataagtgtgatgtgatgctgagaagaatgtacattctgttgatttcgggtggagagttctgtagatgtctattaggtctgtttgttccagagctgagctcaagtcctgaacatccttgttaattttctgtcttgttgatctaatattgacagtggggtgttaaagtctcccactattattgtgtgggagtctaagtctctttgtagggctctaagaacttgttttatgaatctgggtgctcccgtattgggtgcatatatacttaggatacttagctcttcttgtcacgttgattgctttaccattatgtaatacctttatttgtctttttttatctttgttggtttaaagtcggttttatcagagactaggattgcaaaccctgcttttttttgctttccatttgcttggtaaatattcctccatccttgaggaatgtgtgcctctgcacgtgcgatgggtctcctgaatacagcacactatgtgtgcctctgcacgtgagatgggtctcctgaatacagcacactgatgggtcttgactctttatccaatttgccagtctgtgtcttttaattggggtatttagaccatttacacttaaggttaatattgttatgtgtcaatttgatcctgtcattatgatgctagctggttattttgcccattagttgatgcagtttcttcatagtgccgatggtctttacaatttggtatgtttttgcagtggctggtaccagtttttcctttccatattagtgcttccttcagaagctcttgtaaggcaggcctggtggtgacaaaatctctcagcattttttgtctctaaaggattttatttctccttcactgatgaagtttaatttggctggatatgaaattctgggttgaaaattcttttctttaataatgttgaatattggcccccactctcttctggcttgtagggtttctgcagagagatccactgttagtctgatgggcttccctttgcgggtaacccgacctttctctctgtctgcccttaacattttttccttcatttcaaccacgatgaatctgatgattatgtgtcttggggttgcttttctcgagaagtatctttgtggtgttctctgtatatcctgaatttgaatgttggcctgtcttgctaggttggggaagttctcctggttagtatcctgaagagtgttttccaacttggtttcattctccccatcactttcagatatatcagtcaaacgtaggtttggtcttttcacatagtcccatatttcttggaggctttgttcattccttttcattcttttttctctaatcttgtcttcatgctttatttcattaagttgatcttcaatctctgatatcttttcttccgcttgatcgattcagctattgatccttgtgtatgcttcaggaagttttcatgctgtgtttttcagctccatcaggtcatttatgttctcctctaaactggttattctagttagcaattcctctaaccttttttcaaggttcttagcttccttgcattgggttagagcatgctccttgcctcagaggagtttgttactctccaccttctgaagcctacttctgtcaatttgtcaaacttattctccgtccagttttgttcccttgctggtgaagagttgtgatcctttgaaggaaagaggcattctgagttctggaattttcagcctttttgtgctggttttttcctcatcttcatggatttatatacctttattggtctttgatgctggtgaccttcggatggggtttttgtgtggatgtcctttttgttgatgttgatgctattcctttctgtttgttagttttccttctaatggtcaggcccctctcctgcagtgcttctggtgtttgctgggggtccactccagaccctgtttgcctgggaatcaccagcggaggctgcagaacagcaaagactgctcctgttccttcctctggaagcttcatcccagaggggcacctgccagatgccagtcagagctcttctgtatgaggtgtctgtcaactcctgctgggaagtgtctcccagtcaggaggcatgggggtcagggacccactagaggaggcagtcttacccttagcagagctcgagcgctgtgctgggagagctgctgctctcttcagagctggcagatggaatgtttcagtctgctgaatctgtgcccacagccaccccttcccccaggtgctctgtcccagggagatgggtattttatctataagcccctgactggggctgctgcctttctttcagagatgcctgcccagagaggaggaatctagagaggcagtctggctacagcggctttgctgagctgtggtgggctccacccagttcaaaattcccacagctttgtttacattgtgaggggaaaactgcctactcaaacctcagtaatggcagacatccctccccacaccaagctcaagcatcccagtttgacttcagactgctgtgctggcagtgagaatttcaagacagtggatcttagcttgttgggctctgttggggtgggatccgctgagctacaccacttggctccctggcttcagccccctttccaggggagcaaacagttctgactcgctggcattccagttgtcactggggtatgaaacaaaattcctgcagctagctcagtgtctgcccaaacggcctcccagttttgtgcttgaaacccacggccttggtagcataggcactcaagggaatctcctggtctgcaagttgcaaagaccatgggaaaagcatagtgtctgggccggaatgcaccgttcctcacagcacagtccctcacggcttcccttggttagggaaggtagtttcccaatcccttgcacttcccgggtgaagcaatgccccaccctgctttggctcaccctctgtgggctgcactcactgtctaaccagtcccaatgagatgagccaggtacctcagttggaaatgcagaaattacccaccttctgcattgatcttgctgggagctgcagaccacagctgttcctattcggccctcttgcccctatatgtctatcttaactatttttttttattattctggtgtgtgatttctctctttcgtttaatggttttcacaataaataagccttaatgccagatatcttaaaaataatatttgtagtgtcattcacttaatctaaaaatactcacaattgttcttcagtgttgccaagtttttcagtctactataagagcttgatcttagagtgtgttcactgacctcatattacatatagaatgtatacaaaaaagacctttaaaatgtagggtgataacatctattccatatatgccaacattcttagatattctcaactttagtcttctctcaaattgatcccctactgacattaaaaaattactaactttttatagcagcactgtgcacagctcttatatcaagagtaagaaataaacttttccaaaaccgcttaaaaacagagtaacattcagccaggcgcggtggctcatgcctgtaatcccagcactttgggaggccaaggcgggcggatcacaaggtcaggagatcaagaccatcctggctaacatggtgaaaccccgtctctactaaaaatacaaaaaatcagctgggcatggtggtgggtgcctgtagtcccagctacttgggaggctgaggcaggagaatggtgtgaacccagaaggtggagcttgcagtgagccgagatcacgccactgcactccagcctgggcaacagagcaagactccgtctcaaaaaaaaaaaaacaggtcggtgccaaggctcatgcctgtaatcccagaacttgaggaggctgaggcgggtggatcacaaggtcaggaaatcgagaccatcctggctaacacggtgaaaccccatctctactaaaaatacaaaaaaattggccgggcgtgatggcaggcgcctgtagtcccagctactccggaggctaaggcaggagaatggcaagaaccactgcactgaaatcgcaccactgcactccagcctgggcaacagagtgagactccatctcaaaaaaaaaaaaaaaaaaaaaaaaacagagtaacattcattagaagaacatagaagaaagaaaaaaaaatagagtaacaaagatgtcaagacattctctatatccactaggccaggtgtttggagtagaagaaaaatgcatagtgactgatacaagttactcatgagcaccaaccacatgttcacaagtggtaccttacttatcacacattggttaataccaagtctaacttaagattccttccctggataaacatccgatcatttttttatggatccaattctagcccactattttagcataacaaaggtcaaacatgttagatatcttaaacccagagttatttactctctgtttttaagacaaaaatgtttcctgatagatttcaaagagattccaaaaagacagcttcctctaaatttaaaataaagttcaggtacgcttaatttatttgcttctgtttcatctttggatttaatgttttccatcccaggtaaaataaattcccccagttgttaaatgaatttgatcttaactatgcccaatcttaatatatggtatagatgtatgtttatattagaatgggcaaaaggccaacaaaaacttcctgtctgatttttttcttaacaaattgtacactgctgcctaccaaaacttctgtttattcacataatgctgtatcatattcccaggacttgctgctctgacccaaggtgagaagaaatgcctttgtcctacaaacatgagcatttagcttaagttcaaacactgacaaagaagactgaaattggatacttaccagaataatctcccatatttagtttctctaaattcacagatgatcattatcaaactttcaaaaatatcataactattctcaatgactttaacattaaagttgggaaaatgactaaaattcagttacctttaattttaaaaatgcaaatttaacatgaagacataaatgtgtcactatcagtaatgacacatgtggtggaccattacattctgcaccaaaagtaccaagaagggcttcagtaactcccaatgtttggatggggagcttagaacaatagagataaataccaacatcaaaatgagagggaggaaacattataatttcttcattaagcaaacagtaaggttaaaacaaaatatgtaacttaaacttcaaagcacaaaaataattcttcaaaatattctaaacattttcatccaataagtactccgtatcaacaatcagcacctcacttggaaaatcagtcacaagtcagctgttaatgctgtgtggatgcaaccacagatcattacctacttaattgtgtatacatctaataggctcatacagctcttttagaacaaaggttttataatggagtagatgataaatactgaactgtagtgctaccaggtgctatactaatatgagcagaatttatatagagaattttagcctgtattaatgctgtaactaaaatagaaaaaaatgatttaaaatcaggtttgtaataatacagttaaaaaagaaatgcaatattacaagttcatattgtggcatcttgctaaaatcccataagtgatactaaaaatgttaagctaaatatagtttatctggtcaatgaatgcaactgtcagttgaccacagaagagagaaaagcaatttacattgtaaaaatttaaagacatccaatctaaaatttaatgttgactctgaagaatatcaattaatttatattttctgtcatttgaaactagagtgtatgaaagtaaacctgtacatacacatactcttctaaatcattgaacaaaatatggagcaaaccagcaacactactccatcttctggtgacattttccctcacctagatgtatttcagtgtaagtgtttctactgctgtcacatttggagcatgagatagggtataaaagatgattagcttcttcctaaatagcaaacatgaaattgtccaaacatgatagtttagagagcaaaaataagtacgccttaaaaaaaataacagaacaaactaaacttctcattacatattaaattagccctcaggtaatcagcccctaacaaacagcttaacatctacaaaaggctgcatgactggtgtgtgcctgtttaaagctctgctgtaagctgaactgttggtctcagctaggcatcctcaacatttcctttgaattttagccaacagtgccctaggcatgctcctagcactactattaacaaaacagctgtagttgaagcagtagtctttttgcctgacaaggacaccgtaacagtcattgtgatgtcttctgattgtgaacacaggtagagatgtacagcttggatacaaaaatttaatatgagtgtatttgagattataatttttactagttgtatagtaaatatgtgactaagcttgcttttctgaaacaaatgctgctgagtcaataccagacagtcccatgatcagtttggccaagtcacagtggacaacccagagctaaagtatgacatttttactcttcttcagctccctgtaccttagtctcagctgttcccatattcagtctctttagctagactaacaaaaaaagaatggagactcaaataaaaccagaaataaaagaggaaacattagaagtgataccacagaaatacaaagaattaaaaaagactcctgtgaactattatatggcaagaaattggataacttagaagaaatggataaattcctagacacataaaaactaccaagataaaatcatgaagaaatggaaaatctgaatagaccaataatgagtaagaaaattaaatcaaggccgggtgcagtggctcacgcctgtaatcccagcactttgggaggccgaggcaggtggatcacgacgtcagcagttcaagactagcctggccaacatggtgaagcccagtctctactaaaaatacaaaaattagctaggcatggtggcacacgcctgtaatcccagctactcaggaggctgaggcaggagaattgcttgaaccaggacccaggaggcagaggtttcagtgaactgagatcatgtcactgcacttccagcctgggctacaaagggaaactccatctcaaaaaaaaaaggaaagaaacaaagaaaaaaaaaaagaaaattaaatcaataattaaaaagtctcatcaaaggaaagcccaggacctgatgacttcactgctgaattcaactaaaatttaaagaactaataccaattctcaaactcctccaaaaaactgaagaggaaggaatactacaaactcattttatgaggccaacattacctgacaccaaagccagacaaggaggctacaagaaaagaaaattacaggccaatattcctgatgcacaaacatgcaaaactcctcaacaaaatactaacaagctttaaaagaccattcaccatgatcaagtggtacaccacattaacagaatggagaacaaaaatcatataaacaactcaatagatgcagagaaagaatttaacaaaattcaacatgctttcatgataaaaacctctcaacaaattagatatagaaggaatgtatttcctttttttgttgtttgtttgtttgtttgtgatggagtcttgctctatcacccaggctggagtacagtggcgcaattgtagctcattacaacctccacctcccaggttcaagcagttctccttcctcatactcccgaatagctgggattacaggcccacaccaccacacctgctaatttttgtattttatcagaaacagggttttgccatgttggccaggctggtctcagactcctgacctcaagtgatccacccacctcagcctcccaaagtgctgggattacaggtgtgagccaccgtgcctagcagaaggaatgtatttcaacacaataaaggccgtatttcacaagcccatagttagtgttatgctcaatagtgaaaagttgccaaaaatacacaatgtggaaaaaatagtctcttcaataagtggggttgggaaaattgaatatccacataccaaaaaacaaatttatttttatcctacatcacaaacaaaatttaactcaaaatggattaaagctgtaaacataagccctgaaaccataaaactactataagaaaacaaaggggaaatgctctatgacattagttttcacaatttttttaaatatgatgccataagtaccagcaacaaaggcaaaaataaataagtgaaattatatcaaactaaaaagtttctgcacagaaatggaaataatcaacaaaatgaaatagtaacctatggaatgaaataaaatgtttgcagaccatacatccaataagaggttagtattgaaaatctataaggaagtcatttaactcaaaagcaaaaaagaaaagaaaagaaatgacccacaaataacctaattaaaaatgagcaaaatacctaaatagacatttttttttttttgagacctaagtctcgctcttgtaccccaggctggagtgcaatggcatgatctcagctcactgcaacctccgcctcctgggttcaagcaattctcttgcctcagcctcccgtatagcagggattataggcacctgccaccacgcctgctaatttttgtatttttagtagagacggggtttcaccatgttggccaggctggtcttgaactcttgacctcaggtgatctgcctgcctcagcctcccaaagtgctgagattacaggtgtgagccactgtgcccgaactaaatagacatgtttcttttttttttttttaaatcctttaagttctagggtacatgtgcacaatgtgcaggtttgttacataggtatacatgtgccatgttggtttgctgcacccatcaactcgttatttacattaggtatttctcctaatgctatccctcccccagccctccacccaccgacaggcctcggtgtgtgatgttccctgccctgtgtccaagtgttcccactgttcaattcccacctataagtgagaacatgtggtgtttggttttctgtccttgtgatagtttgctgaggataatggtttccagcttcatgcatgtccctgcaaaggacatgaactcatccttttttatggctgtatagtattccatggtgtatatatgccacattttcttaatccagtctatcactgatgaatatttgggttggttccaagtctttgctattgtgaatagtgctgcaataaacatacgtgtgcatgtgtctttatagtagcatgatttataatccattggatatatacccagtaatggggttgctggatcaaatggtatttctgcttccagacccttgaggaattgccacactgtcttccacaatggttgaagtaatttacactcccaccaacagtgtaaaagcattcctgtttctccacatcctctccagcatctgttgtttcctgactttttaatgactgccattctaactggcgtgagatggtatctcattgtgattttgatttgcatttctgtgatgaccagtgatgatgagcattttttcatgtgtctgttggctgcataaatgtcttcttttgaaaagtgtctgttcatatcctttcctgactttttcatggggttgctttttcttgtaaatttgtttaacttctttgtagattctggatattagccctttgttagatgggtagattgcaaaaattttttcccattctgtaggtttcctgttcactctgatggtagtttcttttgctgtgcagaagctctttagtttaattagatcccatttgtctatcttggcttttgttgccattgctttgggtgtttgggtaatgaagtctttgcccatgcctatgtcctgaatggtattacctaggttttcttctagtgtttttatggttttaggtctaacatttaagtctttaattcatcttgaattaatttttgtataaggtgtaaggaagggatccagtttcagctttctacatatggctagccagttttccctgcaccatttactaaatagggaatcctttcttcacttctttttttttttttggtcaggtttgtcaaagatcagatggttgtagatgtgtggtgttatttctgaggcctctgttctgttccatcggtctatatatctgttttggtaccagtaccatgctcttttggttactgcagccttgtagtatagtttgaagtcaggtagcatgatgcttccagttttgttctttttgcttagaattgtcttggcactacaagctcttttttggttctgtatgaaatgtaaagtagttttttccaattctgtgaggaaagtcattggtagcttgatggggatggtattgaatctataaattaccttgggcagtatggccattttcatgatattgattcttcctatccatgagcatggaatgttcttccatttgtttgtgtcctcttatttccttgagcagtggtttgtagttctccttgaagaggtccttcacatcccttgtaagttggatccctaggaattttattctctttgtagtaattgtgaatggaagttcactcatgatttgggtctctgtttgtctattattggtgtataggaatgcttgtgatttttgcacattgattttgtatcctgagactttgctgaagttttttatcagcttaaggagatttggggctgagacaatggggttttctaataaacaatcatgtcatcttcaaacagggaaaatttgacttcctcttttcctaattgaataccctttacttctttctcttgcctgattgccctggccagaacttccaacactatgttgaataggagtggtgagagagggcatccctgtcttgtgccagttttcaaaaggaatgaatgcttccagtttttgcccagtcagtatgatattggctgtgggtttgtcataaatagctgttattattttgagatacattccatcaatacctagtttattgagagtttttagcatgaaggctgttgaattttgttgaaggccttttctgcatctattgagataatcatgtggtttttgtagtcggttctgtttatgtgatggattatgtttattgatttgcatatgttgaaccagccttgcatcccagggatgaagcctacttgattgtggtggccaagctttttgatgcgctgctggattcggttcaccagtattttattgaggattttctcatcgatgtttatcagggatattggtctaaaattctctttttttgttgtgtctctgccaggctttggtatcaggatgatgctggcctcacaaaatgagttagggaggattccctcttttactattgattggaatagtttcagaaggaatggtaccagctcctctttgtacctctggtagaattcggctgtgaatgtgtctgatcctggactttttttggttggtaggctattaattattgcctcaatttcagagcctgatattggtctattcagagattcaacttcttcctggtttagtcttgggagggtgtatgtgtcccggaatttatccatttcttctagattttctagtttatttgcgtagaggtgtttatagtattctctgatggtagtttttatttctgtgggatcagtggtgatatcccctttatcatcttttattgcttctctaaatagaaatttttcaaagaaagcatacaaatggccaatagatatataaaaaggtgctcacatcactaatcatcagagtaatgcaaatcaaaacaaaataagatatcacctcacacttgataggatagctactaccaaaaaacaaaaggtaacaagtgttggtgagtgtaatcagaaatgggaatgcttgtagagaaatgggaaccttggtgggaatgtaaattggtacagccactatgaacagtagtatgaaggttcctaaaatagattttaaaaaaatagaactattatatgatccagcaatcccacttctgagtatatatccaaaggaaatgaaatcagtattttgaagaggtatctgcactctcatgttcattgcagcatcattcatgatagtcaaggtatagaaacaacctaagtgcctaggatatactttaaaggtttagacgacacgggattctagaaattgtcaataaatcaaaattccattgcagtagaaaactacaaaatgatgtactttctgtattgtttgtgtatccacgataaagtggctgaaccagatgatgcttataagtctttcctttgtctacagtgttgtaatattattgcattttcttctttaaaaaaaaaaaagggccaggagcggtggctcacacctgtaattccagcactttgggaggccgaggcaggcagatcacaaggtcaagagatcgataccatcctggccaacatggtgaaactccatctctactaaaaatacaaaaattagctaggcatgatggtacacacctgtagtcccagctactcgggaagcggaggcagaagaattgcctgaacctgggaggcagagattgcagtgagccaagatcgcgtcactgactccagcctggcaacagagcgagagtccatctcaaaaataaataaataaatatttaaaaatttaacatttttaaaaaggcactactgaattattttcatttactggcacctcaccgcctaatacagtatattcgcatgtatagataaatgttaaaagcatctttgttgttcctgcagtttgatatgaaacccaatttcctggattattccatagtcccaatgcaacaaggttcctacagactcaagaaagtccatacccattctggtactcctttcatcctggtagaaaattctgttctacttcagattcctagggctcaatctgaaagagcagaactcccacctggaggacaagcataatcagaaagaagtggacttcactgaaaagtcaattgtgctgcatcctcatttcagtcctttgttgtacatttctgtgaacactcaaagaagttcactcctttcttcttgagtaggaaagtggaaatgtagagtggctggaggcttgcgttttagagaagactgcacccacatcttttattaaggggactatgaggggctcctctattccacatgtccctgaatacaggacagaatgtcactactcgaccacctagcaagtgtccagcaaaggaaatgctcctcaagacacaggaggtagcagaagtatgtttttccctggagagaatggggctcacttccacaaaggctgccatcagagcctttcattatagccatatataagcaaggcctcccaaaccatgaaccccagtgaaataaactgaatgtcctggctttgttttaacattagaagagatttctgcagccagtccaatctcagcatcatgcagcttttcaaacaggaaaagaatgcttttcatactataggtcctctcttggtttcaggatacaaaccagataccaaggatcaatagagggctcaccaaagaaccaaaggttgtgagaatatatcatttcctgttattgtcccaactcttgtcattagcaaagtatgtggccttgtacaagatatttaatctccttgcaactcatttttttcatctttaaaataaaacagttggggccaggcacagtagttcatgcctctaatccttgcactttgggaggctgagacgggtgaatcgagttcaagaccagcctgggcaacatggtgaaaccctgtctctacgaaaaatacaaaaaattagctgggcatggtggtggatgcctgtaattccagctacctgggaggctgaggcaagagaatcacttgaacccaggaggcagaggttgcactgagctgagattgtgccactgcactccagcctgggtaacagagcgagattgtctcaaacataaaaaataaaataaaataaaacagttaggttagatgaattctaaagattctttacttggtttaaggttctctagtatagcatagcctctgtaatttgcatcttaaaccaccaaaagtcataatcttagtagtgaaagattaccttcttttcatgcacagatcactttcaaagtgcaaaacagactaaagaagacattttcagagttaacttgtctatttttttttattattatactttaagttttagggtacatgtgcacattatttctcctcaataccaacttttattgacaaccttatggacttaggtatgtcaatataagacatgcacaaataagcaccatattgatgcaaacactgaagttgttttttgtttgtttgtttggttggttttgggtttttgttttgtttttgttgttttttttttttttgccatctctggaattcctatcagcattgtaaattttgaaacaacccataacaaagaattaacttgtttcaataaacattccccacataaagtagctataagctgcccacaacgcaaactactgtatagcaaacaaccttgtaaaaattaataaatcttctctggtgcatgaaaatcagctaacgcttgactcaacagctttctacctaagtgccaccaataaactgagccccagagacaacagacggaaacagaatagcaaaccttaggaattaaaagatgtctctataatgtttttactttgctaatttaatagaagacacttagttatcatgaccattaactatccaatgtggaaatcaaattttaggaggacaaatgtataatatgcatcattttcatcattcattttaaaataaaggcaagtttcttacattaaaaaatccataagattttttcttcagactgtaactatagaaaaacaaatcaccctataaagatctgtagtttatgaagtagtgaaaatgatcaaatggctattgcaaaaagctggatattaggaaatgtgaatattaattctgaatttgttactgactcaggatgaccttgcatgatgcatccaaccttcttttctctatatcagaaaactaaagaataaatgtaacatcacattcttttctcctttgggacaaacaactatgtacaattgaataaaaatgaaattgcataagtagtggatagaatatgtttgggttggtttgaacttagcacactgtttaataattcaacattttttatacctgtgcaataaatttttaaatgatgtctgaaatgctttgaaatcttcagaaacaggtttataaatggcataaaaaatcattttatttgatctggtaaataagaaatagaataccacctaagacagacatgaatattttagtatagcagtccttggttcacttacccttaaaaggaataattcaatcagaattctttcaggacagttagattaattacagaagaaggaaaaaaagaatcttctcccaattgagcaattaacatacttcatcttacaaaggtcactgaagttaatccatggctatagaactattgctctagaagcttagcacctccccttagtactcattcagtccagctcccacttacacccttccttagactgcatctaaacaattccagatacacatgttctttatcttttattttattgatttatttattttttgacatggagttttgctcttgtcacccaggctggagtgcaatggcatgatctcatctatctgcaacctctgcctcctatattcaaatgattctcctgcctcagcctcccgagtagctgcgattacagttgcctgccaccatgcccggctaattttttgtatttttagtagagacggggtttcaccatgttggtcaggttggtctttatttttaaaggtcttaaagaaaatatatttacaattccattttaatgttagccccaatggaaagttagtccctaccttataaggtccttgtagataagcaattcccagtgcaatattattctagctgattcactacttttttcttgctataagtccttacatgattgaaggatattatcggaactcatcaactttttcttctctatatgctatagtacaaccacaagcctagcactatttagtttcattttctaagcatttcttccacaggatccctacattgttttgttgtatcctcagagttctcaagttcccagagtaagcctaagagtattttctatgtggtcagtcattatctatctagaattttattttttgttttgaaatatttgattgacaaagattgaatatattcaaagtgtgcaacaagatgattgagagatatatacacattttgtaatgactaccaccattaaattaacacgtctatcatcactcgtgctgtttattaggtccccagaacttgttcatcttataagtgaaaatgtgtacctttgatcaatatctactaatttcctccacccaccaatccctggaaagcactcctctaccctctacttctctgagtttgacattttcagattccacatataagtaagaccatacagtatgtgtatttctgtgtctggattactttgcttagcaaaatgtcttccaggttcaaccatactattgcaaaggcaggatttccttcctttttaaggctaaataatatttcattgcttatatgtataccacattttctttattcatctgttaatagacacttaggttgtttcaatatcttggctgttgtgaataatgctgcaatgaacgtgggagtgcagctatctcttcaagatactgattccattttctttggatatatacccaaaagtaagattgataggtcttatgatagctctatttcatatgtttttagcaacctctatactttttccgaaatgactgtaccaatttacattcccaacaatgtgcaaaggtttccttttcttcacatcatcactaactcctgttatctcttgtcttgcacacctgttaggatggctatcatgaaaaagataagagataacaagtagaattttatttttcaattgaaaaatattaacccgcagtcatttttatcaaataaattttatctaacttatttttatttttcttctgtttaataaaagtttgttttaaattcaatttttatcctacaaggtattatgtacccttctggctttggaattacctaaaaggggtcacacacccagtttagtaaaagaaaaaaaaagcagttgttcactcctgagcatcgtcactaaaaaagtaccatgtgctgaacaatacctgaagcataagggaagcttggatatatagaatgtattattaacctgaattggacgttagccagaacactgaacctacttcccccaagagattgtcatagtacaagtcctcagtactttaactgcccatcaagagatatcaccttagaaacatattagaacaaaatgttgcagctcccttcttgagaggtgtcagcatgttctttttgttacatagatcaccaactgctagactatgtatgtccaaaaacattctatcccatatgttcagaacagtgctggaccctatgtacagcacagaagtatacaaaataaagaacatatccatatccttatggaacttacaacctatttaagaaaatggcttatgagaataacagaaaacatataatagctaccaattatactaaacacatgtcaggtgcaatgttaagtcctttatacatatttcataggacttactttatacttgatatattgtttcctcaaagcaagctatttaagttagggttatttttccgatgctttttaaaaagaaactcaggtatccagtacaaacagtctaaccaggtttgggtaactacaaagctcacactctaatcactgtactacatggattctcaatgagtatatcatcaatcaaatgctaaattgtatgacacaaataaaagctaagaatggcaaagagtgaagagttatattgactagaggtcacaggaggaggtgttatgagggaggctagacttcagtttgactttaaagaatgatttaagtatgtaaaatgaaacgggctgtacattctaaatacgaagttatataaaccttgtgcacaggtcagaaggcaagaatagtatgccgtgatcagagagacaagaatcagatacgtgatgtgttccaacatgcatgcaggtctgaagtacaataatttaattttacatatttttatatcaatgtctaaatgtgctttagtctatataatgttcaactcaataatgtcaactttaatttatatcaaaagacttcagaagcctctggaaatggatgtgttttataatgttattataagttttaagggtagataaagagaggaatgaattacattagagtccacattatcaaaccttattttgttttacttcacaaaacgaaagctctaaggaaacctcttgatttataagcactcaaattaatacataaatctgagatcgatataatagctggaacttgttattaccattcctatgtcacaccaactagaaggatgaaaaccaagtagtccaagcagataaactccaagactgtacctgcctttcgatagtaagaaccaaaagagtgtccaaattctccggttaatcctgctttgtcatccgtttactttaggctgattcatcccagtaaacccaccacctcacctatcacagcctcctctcacaccttttccaatcaaagctatttcaacattagtctttttgaaagtaggaaaatgtagagatgttgtgccctgacccaaggaatagctgatgtgcaggcactcactcttttaaataaataaatactaagttcagacctaggaaagaaagcacagtaacctcagaaaaacagaagtgagagaatggagcaaagaactccagtagtcttatcttgtgccgagaaagaaatctctcaaagatgatgttaaaaatatcatagaaggggacagaaaataaaacctaatggatgactccaataaaataattatagtcaattcattggacatccataattcagagttaacactggcattttctgtttgttttaaaaaatggatagaagaataaaatatgttaggagaaaacctcaataatacataggggcaagggaaaatctctcagcccttggtatccaggaaaccaaaggcttatgctcttttgaattttaaatgtgtagcaaaacacattgattttaattgcctataatctgaggtcaaaccttttggcatggttctttgttcatagcaacaacaccaccaataatatttactgaggatttgccatgagtcagatactgttaggagcactggagaggatacagcattaaaggtgacagacgaggccctgtccttttggagcttatgttctgtcccagtgcggaatgataaatatggttggaccagggaacaaaccatgactaattctctaatacaaagaataccaccttataaagaggaaactttcttgctaaactggcaattttacagaggcctgaatcttttccattagaagaaaaacactttctggcgtgtgcttcatcaggttttggagctttaaaggaatagaatgcgagataaaagataaatcccatcaagctagagaagagctgatgttctgaccctttgaccctgcccatcaagaagacataacactccaggtttgaagtcagacttgatttagatttgaagcccagtttcacgccttattagctccatgaccttaggcatgttacttaacttccttaacaattttctcatctgtaaaatggtgctaacaaaagccacctcactgtattgttataagcatttaaagattcaattcataaatgtttaaatcataccatgtgccatatgcttttcatttaataaatagtatagatgatttatataggcatatatgtatacactccatgtgctcatcttttctttatgcacatataatttacccatctatcctcaatgccattctcccagagttctacccttctgcccctgaggcatttacattcttccaaattcacaattagctaataaaagaatccaatcactgaaaatgtgttaatgagaaacgataacagaagagtacagtgactactgcctgccagctcaaatacccctccatggtaaaatatggttttggaaacaaaactgtactaaaaattgcataggccggaggagtgactctggtgtgaacgctaagcagcatcctctgggggtttgttatagtagcactcagtaaccatcaagtgctaatacctagatcatcattaatttttttaaaaaaacaaaacttaaatggacattgtatcctttttcatgtaaattaatgtgtctgcaaaaagaatgtatttgccctggaacattctataaaacaaatataacccctaggaaaataaggccatagaaaggttaaatgtccatgtaacatctgtgatagagcaatacctagaacacaattctctttttggcccagtaattctagaccatatcatgttgacttaatgagatttaactaaaaatagaaaattctgctttgaaaaccttcatccaaaaggatccaaaacttgtgaattaggcaatggtgagaatgccacaccctttgctactctaagaggaaagtctctcaagtgatcgactcgaggcctggccatgcaagtcagacatttagtcatttttctagactctatccatcatggagcacattaccgaatttcatgcaacctcatttaaacatttaactggctgttctgatcggaataaacctttggtggaagtaaaagcttgacaacgctgacacctagtggctgtgaagaaactggagcagattcagcctaggaagagtagtgagctactgtggcagtgtctccaaaacacacagcatttaatcatgatgaatattaggttataaagtaccagttctaaaacaaaccctataaaagtttatttcagctctctatttatctaggggcctacaaaaggaggcaattaaaaaccttgtatttgaaaagtaaatcttccttcaatcttccacacttagcaaattactcatcttcaaagatcaaagaaaactaaagatcaattcatattttggcatatttatgactattttccttaatgttgcatgtacacccacaaccttatcctggtcttcaggtgatttttctccccaggtcaaatataaaagccaactggccaagccattatagagactccctttatgcctctgaagcgtccctagtcaaagggtagttggattttcacaaaccagcaggaattttctttaagagaggtataaggacacatgtggaaacccctaaagtacacatctaaaagcaaggaccacattgaacactgtgggaagccatatgaacacagcagatcagcacagcacaacctgtatctgctctaaccattagaagataagtttcctcagacccacctgcacctctgacaggcaggatggcaggaagcctaaagtgttcatctcctccaccaaggagagctctgactcctacctgctgacgtttgaaggctaaataatccaaattttccagctccttcccaagcttctggtaggttttctggaggtcagatttgttggcaacatttttgagagactcaaatgtcctttgaaactgaaattgaaaacaaaagtagatcattaggatagcagcagatttttctcaaattctcaacttgctaacacgaagagtcgataatgagcctcagtttctcccattcataatacagtgataacaaatgctagctaattatctttcaatgaaataattagggacacagaaagagttataaaccatattctaagtataaccaacattactgcatgcatgagaagcctgttcagtcctcattctaacaaaagagcatacttcatttaaaaaaaataaaaaagaaagttcatcttttaggatatacttctgctttaaaattttttagaaagcactgtgaatgtataattttaaatcataatgaggaagcattaaagagtgctcacatttcaatcatggaaacaaacaaatttatgaaaatgtagttgcttacacgatattttgctataatggcatggaatctggcttgcctctataataatatctatgcagaataggtcacccaacaaacttcagcaagaaagatctctcagagcttgtattttgagaaggaaggaaaacttaacattttgatgatcaaagcatatgtggcatgttcagcaaacatttattcatttctgctctataacacagatgagctatgagcagatgagttatgatcagaaagagagttctgatcagttctgctgaatcagaatgctcctattctttttaaatcagatactagataaatacaaaggtgaaaaattgcaacgaaccacagaatactgtctgctactaataattaattaagcaaaggaagctcacaagaaattggattcttggtttattttcataaattagaacatactttggagggttagtgattgaaaatgtcaagtaatgtaatttgcaagacatttgcatttgctctctctttatgtcatttatttcccatattctcactctgtgccattagacagatttctacagatagagacttgaccatcttaaacacaccagaactccactgtgactatgatgccatgagacaggctaataagattttatagaatataattaagtttccagggaaatgatttgacccttactatatcaaactctatgaaataagtcatattaaaatggcattctactgaattaaatccctaatttcatgaaagcaacatgtttatctcaatccaaggtgacagagggaaaagaaatgggaaataacagtgctaagcttccatgacaggacagtaaattaaattcaacaaataatcatttagaacctactatgcacaaagcactatgaatataaaagacatttcctgccctgaaggaactcataccactggagaaactagacatgaaattcggaaatgagatggacactgacacttactgagtgcccactcagccccaggtacttgatgctttccaatttaatcttcacaagaaccacaggagttcctatttctcttctcattctataattgagtaaactgggtttcagaaagtttgattgaactgggtttttattacaacattcatgttctttctactctatccttaactctaacacaaggcaaggtagtaaagagagtgcaaaaaaagagagataaaggtaacattggtgaaaactcggaaaactcactgatactgacactgacggagggactcagaccacgtagaagacgtaagacaatttgagttgggccccaaaggacaggaagtcttttaagagtctgacgtggaaaccaattctacccaacatattaaacacagccaaaatcagttcattttcccccacttataacaataaacaagttcctttcaacataattttaatgacctttatatgaaatatttattatattgtataatcatttctgtgccttgcccatttcttggttcattctcactatgttcaaatcaaaataaaaccttatctaagattctaaaaaatttaagtaattttatctatgatttaattaatacaagctattttactgacaaatccatttaactctaaagcatgttttagcccctgcactttgtcttccctaagaaatattagctctacttcttaaaatattttttcttcatatttatctctgtaaacattatacaactccaaatgggaactttagagcaaacacacttgtaaagagtgttcaaaatagccgggcgcggtggctcacgcctgtaatcccagcactttgggaggccgaggcgggcggatcacgaggtcaggagatcgagactatcctggctaacacggtgaaaccccgtctctactaaaaatacaaaaaattagccaggagaggtggcgggcgcctgtagtccccgcgggaggctgaggcaggagaatggcgtgaacccggcaggcggagcttgcaatgagccgagattgcgccactgcactccagcctgggcgacagcgagactctgtctcaaaaaaaaaaaaaaaaaaaaaaaaagagtgttcaaaataagaaacacagaaaaccaacacttcaggtaatatgcccatggccaaaggagaaatggagaaaatccagtaacaatacatgatcacaagaatgttttaactaaaggtcggactttgtataatatggagatttcagcttgaacttttgttatcaggaattatatcctccatttattgataataaagagttcaaaatactgtaaaaccatgataatttcattcatttaagcagttttttttgcttacaacaataattaattgtcaaggagaggtcatatgaaagctgtggtatagctctggcttagctccctattaaacacaccccatccccacctgcacacatgtacgcttaaagatactaaagagtgaaagcaataatcttactttccaagtgatgctgaagtacagaagataaaagttaggttgaggcctaggttttaaagagtattcacttggcttgaagatttttctaataggccacaatggttaatcattgaaacaaacctccaagattttctatatttgttcagtacatgataattttcttatattgattatttctccaaataaatgatctcccagttggagacaagttggggaaaggaagcacaattaattgaagagatttttaatactgctggattttacttattcatagttttgagtgggaatttaaaatgagccaaaaaccccagaataatttgttgaaccttgaatttatcctgtgtttttttttttaactcgttataaaccaaactcaaactttaaaaagctcagtgaattagactaaacccaaaacaaaccttggacatacaagataagaatgggtagaggaaaacaatatccctaagcccagcacttgctggaaaagtaagcactgtcaacactcccagagtgtgttttctcatcaaattatttctgctcagaaataataatagtaatccatcaaataaaacagcagaaactataattgctcatctcacattaaaatagctgacaaattattttgcaagaaagagaagcatagaaaaggcaacaggaaaatgtctactttgtctcagcagtcccttttcccagatacattttttctcctttttcctgacaatacatatataaataaatctaagccagtgttctatacaaattatgcatccaatgagttcatgtaaattatgtagatttgtggagtaatttgagaaagacacgaagaaataggctgaaacagcaggaaaaaaaaatgcagccaaggctctggcaaataaagttttcctctccctcactgccaacgccctggcttccttttgtagtcagatcgattgattcaaataactctagagctccagcagcctactaattcccataatttaaaaacatcaagtagcattgctccaaaacaagagccagctccacagtcatcatgttttcttatttaatatttcatgcatttatacgaggtgctgggtgctacctgtaacatgaaaagaaatcccatacccgcagcgttatgtgtacaaaagggtatacagtaagtgcctgatggaaagcattatatcaccaagtgtgatcttagtgtccctaaatcatctgtttaaaacaatgctaaaagtttctggagcctaaagcagaaggaaagaatagtcaaaaaaataatatattgatgctctataaatattaatacctagagtaaaaagaaattgttttaagcataagaaatagctaatctaccttacttaaatatggcaaccacagagcaatcaaaaataaagtattacagagaaagaaattatttaatgtttctgaatttaatccattgactttcatattttccaaatgaacttacaagatgataataccactcaataaaaagaagtttacaactgaagcagaaaattaaagctcacatacatatctcaaatgatttttttttttttttttttgctgtaaggaatgactataaaagttaagaacatagagcaaaattgggcttgagatctaaattagaaatagttctatgtaggtgaaggcacactggccttgaggtctgaggttcaagtccttgctatgccatttaataactgcatcactttggacaagtcattattattccaattttgattgtgttatctataacacaggacaaattgtctttgcctgcctacttcactcagttgttgtgaaatcagttgaggaaaaataaaagacattcattcaacaaatatttatcaatgagcaacataccagacatgtaagaaacagaggaaaacaaaagagaaacaactcttaccctaacagattttacaatctagctttataggttactgctttataaacttaaaagttccataaaattgaaaagaccattgtcattaagatcatgacacctttcagtagtgaataaggactgaacaaaagggtcattcaataattgtttatagagcagcatcactgtgcaaagcactgggcttgacgctgtgagaaacatcacatttatggtgaggcttgggtggaaaaatgacgaaatcattgatgctttatgaaaagtttggccaggtacagtggctcacgctgtaatctcagcactttgggaggccgaggctggcagatcaattgaggtcaggagttcgagaccagcctggccaacatggtgaaatcccatctttattaaaaatacaaaaattagtcaggtgtggtggcatgcacctgtaatcccagttacttgtgaggctgaggcaagagaattgcttgagcccaggaggcagacgttgcagtgagccgagatcgcaccactgcactccagcctgggtgacagaaaaagacttcatctcaaagataagataaaataaaataaaataaaaagtttatgggcaatgtccccaaagaaatcagcagtttacaaatggataatccattttgagaagggtcaagatgatgttgaagacaaaacccacagcagcagaccatccacatcaatttgcaaggaaaaaattaatcttgtttgtgtcctaattgaagaggaccaacaattaacaccagaagcaatagccaacatcatagacatctgaactggttcagcttacacaattctgactgaaaattttcagttgagcaaagtttcccctggatgaatgccaaaattgttgcacatagatcaattgcagataagaccagagctttcaatgaaatgttttaacaattttaatttcatcaagctccttaagtattcctttggagaaatctaacaaaagatgaatgtggatttaccagtatgatcctgaagactgagcacaatcaaagcaatatctaccaagaggtggaagtggtcctgtcaatgcaaaagcaagctagtcaagagcaaagatcatggcaatagttttttaagatgctcaaagaattttgcttgttgattttctggaaggccatggaatgatagtatctgtttattatgagagtcttttgagaaagctagccaaagctttagcagaaaaacactgggaaagcttcaccagagtccttctccaccacaatgctcctgctcattctgctcattctgctcattaaacaaagccaattttgcaagtttcaatataaaatcattaggtatccaccttacagtcctggtttggctccttctgactctttttgtttccaaatctcaaaaaatatttaaagggcactcatttttcttcagttgataatgtaaaaaagactgcattggcacggttaaattccaggacattcaattctttagggatgaactaaatggctagtatcattatttacaaaagtgtcttcaacttgatggagtttatgatgagaaataaagtttatattttttatttttttcttttaattccatttttctatgaactttgtgaagtcccctcatcattaccctgcttaaaattctttcatggtttccccttagctttcagactatagttcaaactttgtaacttagcacatagacctttcaaattaggtctatgcctacctctccagcttcaactcttgttcctctcacacagttcacccttcatctcagccattcaggactattacaagtctttcagcatacatcctcttctgcaggtaaaatgccctctgccccactaccttctttctctagtcaactctccaaactcagccacacagtattcatttaacataccctctcttaatacaattccaacctccataacactttgtaccaacctctaccataataacatattgttaatttactttttatctagtctgtaaattccaagagagcaggatcatgatggtatttttagaaatttgaatccctagcacatactagagtgatggtgactgccacaaagtaagcacacaaaaataaccatttgctgaggtaatccattaattaatcaaatcagagataactggaaagatgctgattccttcttaaaaaatgaaaattttacatggtttaaatttgtatggtcaaaggtcataaaatttcaattaaacaggaggaataatctcaagagatctattgtacatcatggtgactgcagttaataccaataaattatatacatgaaaattgctagagtaaattttaagtgttctcactaccaaaaattgataagtataaaaggtaatgcatatatattaagtagcttgagttagcgattccagaatgtatacatgtattaaaacatcatgttatataccataaatatatataatttttacttgtcaaaatagggggatatagaagggatggttaatggatataaaaataaagttagatggaaaaaaatctggtgtttggtaacataatagaaagaccatagttaacaataacttatcacatatttcaaaataactaaaagagtagaatcagaatgttcctaacacaaagaaatgataaatgcttgaggtgatggatattccaattaccctgatttgatcattacacattatatgcttttatcaaaatatcatatataccccataaataagtacaactattatgtatctatatgagaacacatggacacaggaaggggaacatcacactctggggactgctgtggggtcgggggaggggggagggatagctttaggagatatacctaatgctaaatgatgagttaatgggtgcagcacaccagcatggcacatgtatacatatgtaactaacctgcacattgtgcacatgtaccctaaaacttaaagtataataataatacaataaataaaataaaataaaataaaataaaatttaaaaaatatacgtttgaaaaaaaaatttcttcttccctaaaatttccaataggaaattcatgacaaatccagcaagtatgccctatttgtctctatttctaatttctcctcttatatcttgatgtggtttggctgtgttcccacccaaatctcatcttgaattgtaactcccacaattcccaagtgtcatgggaggaacccggtgggaggtgattgaattatgggggcaggtctttcctgcactgttctcgtgatagtgaatgagtgtcacgagatctgacggttttaaagatgggagtttccctacacaagctctctctttgcctgccgccatccacatcagatgtgacttgctcctccttgcttccaccatgattgtgtagcctccccagcaaggtggaactgtaagtccattaaacctccttcttttataaattgcccagtctcaggtatgtctttattagcagcatgaaaacagactaatacagtaaattggtaccagtagagtggggtgctgctgtagatacctgaaaatgtggaagcaatttgggaactgggtaacaggcagcggttggaacagtttggagggctcagaagaagacatgaaaatgtgggaaggtctggaacttcctagagacttgttgaatggctttgcccaaaatgctgataagcatatgcgcaataaagcccaggctgaggtggtctcagctggaaatgaggaacttgttgggaactggagcaaaggtgactcttgttatgttttagcaaagagattggtggcattttgccctgccctagagatttgtggaaatttgaacttgagaaagatgatttagagtatctggtttaaggaacttctaagcagcaaagcattcaagaggtgacttgggtactgttaaaggcattcagttttataagggaagcagagcataaagtttggaaaatttgcaacctgaaaatgtgatagaaaagaaaatcacattttctgaggaaaaattcaagccagctgcagaaatttgcataagtaatgaggagccaaatattaatccccaagacaatggggaaaatgtctccagggcatgtcagaggacttcccagcagcccctcccatcacaggccaggaagcctaagaggaaaaagcagtttcatgggccaagcccaaggtccccatgctgtgtgcagcctagggacttggagccctttgtcccagctgctccagccgtggctgaaaggggccaatgtcgagcttgggctgtggcttcagaacgcagcttctgaagccttgccaccttccatgtggtattgagcctgcaagtgcatggaagtcaaaaattgaggtttgggaacctctgcctagattttagagaatttatggaaacgcttgtatgtccaggtagaagtttgctgcaggggcagggctctcatggagaacctctgttaggaagagtggaagggaaatgtggtgttggagccctcacacagagtacctactggggcaccacctagtggagctgtgagaagagggccactgtcctccagaaccaccctagaatgatagctccactgacagcttgcactgtgcacctggaaaagccgcagacactcaatggcaacccatgaacacagccaggaggaaggctgtatcccgcaaagccacagggggagagctgcccaagaccatgggaacccacttcttgcatcagcatgatctggatgtgagacatggagtcaaaggagatcattttggagctttaagatttgactgccctgatggattgtggacttacatggggcctgtagcccctttgttttgaccaatttgtcccatttgtaacagctgtatttacccaatgcctgtaccctcattgtatctagaaagtaactaacttgcttttgattttacaagctcataggcagaagagacttgccttgtcttagatgagatgttgaactgtggacttttgagttaatgctgaaatgaattaagactttgggggaatgttgagaaggcatgattagttttgaaatgtgaggacatgagatttgggaggggctgggggcagaatgatatagtttggctgtgtccccacccaaatctcatcttgaattgtaactctcacaattcccacatgtcatgggaggaaccagtgggaggtgattgaattacagggccaggtctttcctgcactgttctcatgatagtggaagagtctcaggagatctgatggttttaaaaacaggagtttccctccacaagctctctctttgcctgctgccgtccatgtaagatgtgacttgctcctccttgccttctgccatgattgtgaggcctcccctcacaatcatggaatccacatggaatccatgtggaactgtaagtccattaaacctctttcttttgtaaattgcccagtataaagtatgtctttatcagcagagtgaaaacagaatacacatcttaaataccagtcttgacttgctctttttctttacatcttaatatgcttttacatattttgcctaagatcttccacaaaatatacatagcttctaacagctcttaattatacagtaattttccctttatcagctgctgatatcttcagtaataaaaggctttagaaaatctttttgttggtacacatctgccttttaaatagagggtggcctcggagagtctcagctgccaacatggtaatgtgatttttctgtcaatataaatatttgtcatagtcagaattattgtttgtccacaaatgctttataaaattatgtagcaaatgttaaatatacatttgacaaaagttgttaaattctggacccatttcctgtaagacactggtctattacctaatccaaagggatcaacattcccaaaacaagtaaaacatgactatggtatgataaatggaaaaagttagaaaagttagttcaactcaatagtcaaatttcccttcatttttaggaataagtacaacatttcactccaagggccaaaaagtgggagcaagataccaaggagaagaaagatgggacagggaaagaaggtgaaagagaacttataccagttcttgccaagtaatttatgtcatatatcattcagtcttcacaaaaccctttcaaggtattcggaataagttttattctccccataactcagaagaagaaaccaaagctcgcagatttttaactttcccaaaatcacccagctaatcaacaacacagccaggattcaagcaaggtctccatgctgccaaaagccatgttttcttcccacgatgtcctgacccagtaagcagaagccatccaaacctattttcttccaaataaaattgacccttagaaatccagatgccaaggtgggcacggtggcggacgcctgtaatcccagcactttgggaggccaaggtgggcagatcacccaaggtcaggagtttgagaccagcctagccaacatggcaaaacactgtctttactaaaaatacaaaaattagcctggcatggtggtgcacacctgtaatcccagctactcgggaggctgaggcaggagaatcacttgaacctgggaggtgaaggttgcagtgagccaagaccatgccattgcactccaggtgtgcaaaaagagcaaatctctgtctcaaaaaaaaaaaaaagaaatccatatgccaataaaacaagatgtggaatcctaagaagaacaaatagtacagaaaagtctgaaacacttgaacagtatcatagagataaacattttaacttaaattcctataaaaaatttataaacaatggtgacaatagagccaaaatacctttccaagtttctacaattgatgaaatattgaaatatcagcacttttttcctctgtcccctattacctttcatttggacctgtttttccccaaaagaacacacacatttccttaaggaactagacacgtttaaaagtgccatgtcaggaatccttgattatttaatttggcagtacttgtccatttttggttgctcagtgacccatgtttacactagttggtggtctcagactgtgtccttgtaaatgttctattgtaattgcttctcctggggcagtctcagtggaaagagtataatttaatagaaataagaaagctttacaaaatcaggaaatatatagatacatgctattaaaagagagtaacatctcatttatctgacatctaaaaggaaatatacttcaacgggattgaaaaaaatctgttatgtaagaaaagtcataagaaggaaaataagagtaaggccacttaaaaaaaattgtgagctcagaggaattctttaatgctatgaaataaagaacaaaaacagaaaatgtagcaggaacttgtataagtgtcaggagggaaaaaaaaaaagtccagaagcctgaatgaaatagtaaagacaaggagaagaaaggcaggccttggcccattacatgcaaaataagggcaagaaataaaaaggcagtcctctgttttgggggaaaaaaagtgtgttcccaggagaaattcatgtctttaaagtggataccctcctcccaccaaaaatctataatagattattatatagtaggattggggagtgtgatggctgactacagaatgcttcttaggaagggcactacctatactgaagaaaataccttaaggagtaatttaaggtgggtagtgatatcctaaggacagaaataagcaggggccaagtggagtgctagagagataactattctttactgcattccaatgaacataatttagaagtttgagggaaagtagctagagaaaaaatgtggaagggcaatgagatggagttgctatcaatgagattttgaagatttcgaacatacaaattgaagccctttagaatatattgttgcaatatagatatccctcccttccgtcttcctgtaagtttctgtaaggtttactacattcatgtattctggtctgctctggtaggttggagaatgtgtgtatctgtgtgtctattcgtgcaaggggaaaaggccaactccagattctgggtgaatataatgtagaatagagacagaaagacaatctataaatgaaaataattcagtggaagcaaaagcttggagacagagttgaccctgaaaatatgagctcccaaggaatttgcagaaatttgggggagaacattatacttgataggacacagaatgagggtttaaactaattatattgagatcttaagagcaagaagaacccagcaacaagtggttttgcatcataattaagtggattataagtaatttaaaaaatgaaggtcagaacaaaggagaagaaaataaaagcaggcaagcaatggtcacttagagctcttattgggtcattaaaaagtaagtcatgccaaactaacttcatttcctttataactgggattactagactgataaatccacaatgccacaaacagtatatcttgatttcaagaaagtctttcaagaagtgcttgaaaatgaaataaagaagcatggtttatacagcagcccaatgaagcaagcttgaagctcatttcaacaactttactcaaaggatgttcatatttgattggtattatctaaaagaaagatataatactgttttccatgtcattaaacattttttcatgaataaatttgaaaatgatatcaggttaggaaaggaagacaaaatcgagagtcaaaggatgatggactgtaacaaaaagcaggaattaataagataaagttcaatgaatataaatgtaacttctacctttacataattaaaaaaaagactagtatcagaggaggaagacctggattaggagtagtttgagctcagagagttggaggttgtaattgctttcaaaatcaatatgaaccaacaacatgacaaggctactgtgataggtaagatcatgttagacattaaatcagggatgtaattgtccatttatatcatggaatgttcacatcagagagtttgttttgatttcaagacactgatttcaacatttcatggaagttacctacaatctagaatgcatagaaaaggatttacagagatgatttgggggacttctatttcttgtaatagcaaattagaaattcagtctgatcctctgctgaaggaaacgaaggtttgatgataaaataattcatcttaaaaacatcacagagctaataaggcagtgagaaatttcctgaagtgggtttcagaagaggtgatgttcagtatccaatcaaaaatagccattcacattataagacaagacaccatgagtaaaagcaaggaaaatgatagcagaagcaggcacccaaggagtccaaacaccagagttctcaaaccatgaggatcagacagttctgctcaccatgtcgagtagatcaaaataaagactgaaaatttcagcaggaaactaaaagtcatacaaagaaatgtaagccaatttgaaaaatatatagaaattctatggtatttaccatataaagaacatccaaaagtcaaaaaatttttagcctagaaaaggggagacataggtaagtcctaagagtaatcatcagttatttgaaaagagccttttctattgccttgattctgtgttgctccagaaagcaaaactagacgcactgtttgaaatagcagggaggcagttttaagctcagtttgagaaatttgtctccaacaattagaagtgtccaaaatcagcttcactgtctcagaaaattgagattgttatcattgttagtgatcatctattgttaggcagttgcatatgttgcatattatcagagagtctttctacgtcaggtaaaatattaaactgtaagggcactgaagtttctccactatgattcttttgattccaagtagaagctaatattgtcataaacattattagaaaaattccaaactgatatttcccaaagtatggtttcagaaatttccaggattaatatactatggaagagttctggggtcaaaaacatttgggaaattctgagttaagcagagttaaacaggcttcttcatggcaatatttctcaacaattttaacgcgctaatgtgcatcaaaacattcatgggaatttctatgtgcagcattgatcattacaaaaagaaacaacttttttcctcttccatattttcaaagcatgctctacagaatacttttggggaaatgttgggctaaataattctaatcctgatgatctcagaaacaatttagtgattttcattctacatgaagtcttgaaataattgagttgataatgattcatatataaacttttcatgaggatgaaaccatgaaaaactatcacgatttaccacaaaagatgttcccttctctttgataagatgccacttcctttttcataacatataattgttttactacacatacttatatgtgacatataatccagttgaaattcaggctctaacaaggcaccaagtgtgagagaggatggttagaatttaaaacaccttctggtgtatctaacttactttaataactggttgtaggtccatgaatttgcctaaacttttaaaagctgtttgtagttaaagctgttctaaccattagagtagttaagttccaaaagttttaattctttcctgtttccttgagcaagttacttaaattcaatgtgcctcagctttctcatttgttaaatagaaatcatgatcatagggctgttataagaattgaattaaaagaaataatccagcacagtgtttggcacattataaaaacccagcaaatattaactataatttttactgcaagaggtactttgcttttgtttgatctacaatgccatcctgcttcatttgcatggtatgatgtatgtgaattacctacctctgtgcctaactcctagtggacactcaattaaaatggtagtgaaggtggttttattctttatatacagttacctcctaattggttatgaaggtggcaattttcaccttacaaaagccctgcattctgccctatctcaacaaatttagagtctaaaataggaattattgggtcattggaactaggaattacctgccacttaatcttttgtacccatttcttgtttacagcatttgttagtgtctgtattcaaatatgagacaaatgaatctcagaaatgttcagtaatttgtctgtggttattaaacaaaccaagaagcaagtaacagaaatctttgctcaattatgacacctacaaatccactagtaaacagctgctggtgatgagaacaattccctttcctaaaaagctacttaaactaaaaaaaaaagattgaattgctctttttactgtaataaaactatcagttcagtaatttgtctatggttactcaacaaaccaagaagcaagtaacagaaacctttgctcaattatatcacctacaaatcttctagtcaacagctgttggtgatgacagcaattccctttcctaaaaagctacttaaactaaaaaaaaaaaaaaaaaaaaaaaggtattgaattgctgtttttacagtaataaaactatcaaaagaaaaaaatgaaagtacacagagagggtcactctagcgttaaaataagcaatagtgaatacaagaaagatgtggctgggagcactggctcacacctgtaatcccagcactttgggaggccaaggtgggaggatcacgaggtcaggagttcaagaccagcctggccaacatagtgaaacccccgtctctactaaaaataaataatacaaaaaattagccaggcatggtggtgtgtgcctgtaatcccgctattcaggaggctaaggctggagaattgcatgaacccagaaggcagagattgcagtgagccgagatcaccactgcactccaacccaggcgacagtgcgagactccatctcaaaaaaaaaaagaaaaaaggaaagaaagaaaagaaaaagaaagatgcaaagaaaggtttagcttagcagttagagaaaatgattttgacatgaaggttaatcaaataagaccattgcttacttaatagagtagttatattaaaatcacagacactttatgaaaatgcagatttatttatagacagagtataagggtcctatttcaagcagaaaatacaacagatataaaaagagttctttgcaaccttttcatctgaacactactaatgatttggtcaaactctgaaaacaggctttaataaaattctctctctactaaaaatgtgctaagtgggtttgtctgacaaaataaagcattcaggatatcttgctaactttatatcctcctagctaatatacattatttactcatattaaatacatgtctacattttcctaatggattactacagacatcacagactacctgtaaacatgcactctttatcctgaatcaagaggacatggcaaagtagaattcatttacaaaccaggataaatttccaaatgtcttcaactttaaggtttctatttctcaagttatttatactcatatgtttatcatatattatctatataattatgttatttatttatttatagagagcatagttatttaaatgatcaaaagtctagaacttttcctagccatttccttataagcaagccatctcctgtttaatttcccattggctttagaactactctggcttccttattttgaggtatacattagtcttcacaacccagtctagtctgcttctgaaggggtgatgttaagaaatgagagtgaagccaagatgcactaggatcgacgccaggttcagagaatgaaattagaagtgaagacaatgccaaggtaaactaagccatcttttacttacagctgacacatgttgcaagaggcacatgacatcaatcatgtccgcaaggataaggagtctcgtcaccgcagccagcaaggcacgggcagcttgaaccacagcctccctttttgggagaaaacaggggtcatctgtaaatctctcagctgatactttcagagcttcacctgaaaaatacaaccccatataagttatactttaagtttcaactatgcctatttcaggatttatcagctaacctaattccaagtaaattccaagactaagcataatataaaaatattgtcagttgacaattttctctctcaataaacaatgcagtttcaaattaacatttgtttttcacaaatattttggaattaagaagcataatatcattttcctgcaagaaagttgtgctcaactgactaggaacatctagtaaaattgctgccaacttctgcatttgctgaatctcatttcttgtaaaaggttttattactaaagcttcaatcataaacaatcctgcttataaaaacaaggtaaatctttattgagttactttccaaatcaatggatgttaggactgcagctctctgataaaagtttaacataggcaaatttattctaaactatcaatataatgaataaactatatcctaaatttagtcacagaaatagtacttcatagtacctaattgttagagaatattgtgtccactatttttaatgccttttcatttaaaatatattttattataaaagaaatatgtattctttcattgttttaagttcccagttcaaaagggtataaaatgaaaatatttaataaaaaactctctttactcccatccaacaacataattgataattaccacatccactattttttaagtttttaaatctaaacttctttttattataaaagtactataatacgtgtccattacttttaaataatttaccacactaaagaacatcaagtaaaaattttaaaagtctccaaactaatcccccaaagcaccaactattcagctcttgcatatctgtccagaaatttttccatgaatgtatgatttatgtgtataagcatatatagatacatgttttatatacataaatgtatatgtatgttttatacatgtatgtgttttatgaatatattcatatacattcatatatacaaatatgttttataaagacagattttataagaaaacatattttatatgttataagaagaaaatgtaaaaatatagagcctttagcaagtagtatcctactagagagattttctgtaatttcttctttttgcttttcaatttattttcctttcatactgggaaacagatgaccaggaggcaatatagcacagtaattaacagtgtgtactctggagccagactgcttcaatgtctctgtcctagtatctcaatcaagtcacttaacatcattactcttcgttttcttctttttttaataatataaaataataaacctactattttatgagtattaaataagagtacataagttatatttcattgatacactgtaacttattttaccaggcccctattgaacacataagtcatttccaactttttcctattttatataatactataaagaacgtccaggacatatatctttacatgcatgaacaagtttagctttaggataaattcctaaaagtagaattcctgagtcaaggggcaaatgaattttaagttttgttatatattgccccaaaattctccaaaatacagtcatcccatcaaaaatatacaaaagggtctgtcttatccatttatggattacatccataaatattttagtttcattgactcatgaaccttaacataaagaaaactgagtcagttattttattaaataaaataaagaatactgtttcttataatagacaaaacttgtgaggagggtctgagactgtctcaacatgttagtatgtctcatttagatctctttagcaataccaagttaggaactaggactctagacacttctgagatcaaattcatatattccccctctagttctgggaacttggacagtaaatgccttcaatgtccttatctataggaaaggggtaaaaatatgacttatctcatagtgtttcttggatgcttagatgacagcattcatatatttagcacagtatttaaacatggaaagcactcaacaaagattaactgttattttggaggaaatttctaatagagatggtaaatttttaatgccaataagtgggtgattttcatctgcttctctgcaagtcagaattgctgctatgagactgtgaaaagttaaactgacttccagaatttagagagcagatgaatgcccacaaaaaagattaattttttctttttgtgattctgagttggaaagttataatagcctttttagaatactgtctttgacttcacatactaaaactaaatatatatcaaaaaattatgtatttttgactctaaaaatgttggaatgttgaacaactggctggagagccatattcagaaagagatcatttaaacaattagtatattcttgtctttgttaaaggaatataaacagccagtcaggtagctctgttgggaagagaaaagtcactcccaaaatacattaataaagatgctacaacttaaattcttattgctggacttatccctaatttccccaatattcctaacccttttcagctggtttcagcccacactctggtcctaagttaaacatcacttcctatgggaagcttggaccccccattaccaagataggtcttacaataagattctatgttttctagcataaccttcatcataatttattataacaaattgtatcaaaacctgtcttttcttctggatcataaaactagtaagtgcaagagctgcattggccctggtcaccacagcatttccaggatctagaagagtgcctactctgttgcagatattcaatacattgactatctactgccaaatgaatatatgaatgaacattattcaacttttctttgataaacatttgttgttccctctataaaacagctgtatcctaggtatccaggatatagatatcagtatgaaacagtatttttgcagcccaagaagttcagatcaagtgaaagtcaacaaacactgatacaggtttctggtacaggcctgtacaaagtactaagagacacagaggaggatctacctctgcctgaggtgtcagaagatatacaaaggaatgttctaggtaaaagaaacatgttccaactattgataaggtattgacaacgacagctggtttatagaatttagccagttcactgtcatattgatttctgacaggagaaaatggttattttcctaattaaatagaaaaaaaggtacaggtttcctttccatctagaatattagcatctatgttttataaagtctacatgtggagagtctactcttttgaaatatcattcccaatcttgcttataatgcttttactttgaagtttgctgaataggaaatttcacttttaaaatacatacaaataaaaataactacattttttcttcaagaaatcccactctatacataaaaataatttactaaaggtcttgaaaatgccagaagaactaggtttagaaaacttctttctactgagtccatttagttcctttcctaaaaacgggattttttttaatcgttaaaaaaaatcagttatgaaatgcctaggtactagagtatatagtctacaaatatctatagagataacttttacacacctatataagtgtaagagatgacaatttctgaatatacaaaaatctggctgataaactttttatatgatcaaataaataaactccagaagtacaaaaaaattgttggccaaatacacatattaccaaatattctttattttataaagcttcctatatggttattttacaagttcctttgcttcatttaaaagtataattctactttctaaaagtgcttatattgattataaacttaaaagtcaaggaaaacatagtataagaaaaatatccagaggaaaaagagaataaccaaaatgaaaaggggcaggtactaaagataaaaaacttcccaaacttttacttgacattatgtttattattcaattaagatttctaatatatgcatctgtccaagtgatacaaatacatcatggtaaaaggtttatatcatacacatataacatgcattagtacatattcattgattcaatatataatagggttcacagactgagactcaacattcagggtttggttttatttgtttttggttgggaaactgccattttgaatttgaaaactctgaagaggtagaagcttgaatttaactttttagcagacaattattttatttggcagggaagagaggaggatgacctcaattcgatcctaaacttacacagatgttaaaaaaaaatagtaaagactcccctttaaaatgttcaagacagtttgactactaggagcaaacatgttttgtatgataaaagaaaaccttatcatggcaggtggaagggcagcaaagctagccactgctgtgtggacccaaggttgggtgctacggcagggttatagactaggaatgtggctgcatatggttgctattgtaaactattggctatgtcttatttccattttattatcttcgaactcagtaaagtcttattaaaagttataatttgcttccagtcaagggagaataacagagaccagattcctttcctacctgaaacaaaaaaatagaccaaataaatgcaaaaatggttataaggcactggatgttaggcagtgaaggacagtaatccctgagaaatggaccaaaaaaaacaggatgagccctttgatagccccagcttaccaccatgagagactttccaggcaatgatacaggaaggggaaaccaaggcagagcctggcaaactctctgagctggggagacaaagctgagagtcctgggagatcaaggcagtaaatgtataaaacagaatagagaatgataaagggaagagatacacagagaaagaacactgataatctgcacatgctccctcttgagtattcagctgaatactgatcaaccagtatactggaggaaaccacccaaggctagggaaagaaccacccaaaaggatttgaggtaactgtacttgccactcacacaggactgggaataatgcttgtccaaccaccagactggaaaacttcataactcatgggacattggatagaatacaaagaagagtcttgcctcaatagtggggaagaattagccttagactgaacattgccctagtgccttctaacaaagcaattcagagaaaacagaattcccaatttcaagaccagcagcattcatgcatcagagaagagagatagccaggtaaaggcaacagcagactagcataatgatttaatgaaaatggaaggacatgagcagccagtcactgagcgctgcaccattgggaactctcaaaataagctgggaaatactttgattgggctgattctattaaaaaaaattttttcataactaatctgtgtttttttattattatactttaagttctagggtacacgtgcacaacgtgcaggtttgttacatatgtatatatgtgccatgttggtaaaattatataaaatgttttataaaacataaaatttgatggggctagtttctataaaagtaatagaaacatctcccaacatcatagataggatatagtagaagctgtcttaaaagacctcctcttaaccacctctctagattaataaactttttattcctctcagcaacatattaatggtatctcctttccggtatgtaaaatatactgaagaccttctgcttccaataattgaagttaatcaagaagttgaaaaggcttgctccccaatcttttcatgtgagttgtaattataattatatagttttattaactatataaacctatcaaatataagtgtaaaaatatctattaattctttaaaaactaatttttaatgctttagagacattcagtaaagatgagttgttaagttgggtatggaaggaaaaaatggtaaaagttggagcagggcaaggcaaggaaaaggattataaaagatcaagaaagattctgcagttaggtagcttcgcaagtgtcattaagttttcttccatgaagacaccaaaactggaaattttagtcaatatagtttggttgtggtttcggtcaaaacgactatataagttatgcgtttgtgtgtgtacaactaatgaactaatgaactttttacttctaataatgagaacaaatatatcttgaagcaaaaattatctgctatattttaaaacactggaaataactttcagtcacatttagtcaaactttaattatgtacttgtatgtaaaagtacacaactcctaacttaaaactttattaatatctttttatgagcaaaatattttgtacaatgtatctataaactatgcacctaaataaatttcaatattaaggaagattttaaaatagagctaaacatctcttcagaatttcaaagaaaaatgaaattttttaattttcaaaaaattgaccaagtaatttcatgtcatatttaaatttgacaatttttttttctatgcaggctctcactttgtcacctaggctggagtacaggggtaatcttagctcactgcagtctcaaactcctgggatcaagcaatcctcctgcctcagccttccaaggagctgagactacaggtatgcatcaccaaacccaattaattttttgtatctcttatagagatagggtctctttttgttgcccaagctggtctagaactcctggcctcaagtgatcctccctcttcggcctctcaaaatgctgggattatagccatgacccaccccactgagctaaatttgacaataattttaagataataaaatacacaaaatatattcctgcaacattattatcatctcctggggttagaagtttcatatacctaaagtggtttacagtaaaacaaactgacaaaggaacaaagcaatccatattgtaaaccagtcaataaaaagaaaatagtatggatttataacttaaataaatgtttaaactttgagctgaaatagctgcccataattattctctattgaatttctttcccaacaacctattgactgatatgccacccaccaataaacacttttatattattcttgatgtaaatttaattcttttgaggtgaaaaaataaaccttataactaagatttccgactaaagttaatttatcattttttctaatatttccttttatggctaaatgtagtaagcttagccatgaatacacttaaattatactatgatgaattggcaaaaactgatatctttgcttttttgacatctgctaaaagaatctcattctagtgctttgaagttgaaagttaatttttaataaatgatacctaacccttacaaacagttcattcattcatatatcaactattcagcactaaaatacgcaaagcactatggggtatacaacaacgattataacatggtctccaccaggtaccctcaaataggaaaatgaaccacttcaatgagaagattcttctgtttggttttaaatgtcagcatcttcagatacacctaccttaaagtatattaagacataattccatagcacctcccccccaaaaaatacaagtataataattcttcatatgcacaattcctagatttcaatattttatgtatgatttaaaagttctctgagaaaaaatgaaaaacgagagtgactacatcaaaggatcactcaatcattttaaaataaaattaccagttatcaattatcacttataatcagcctcaacaaagttctattcatcaagaggttaagtaataaagtagaattcaggcttcaccttactagaaattcaagtcccacagctgtgatcagagcaataaatatttaacaaatttattctttcatatatcaccccattcagagtactacagctgttaatcagtaaggtcaaatttggccctattgatatgctccttatgcagaaatgacagaagttattttagggccccattataaagtcttagttcacaagctcacacaaaacttgcaaggaagtcaatgtggccaactgtacatactgaaagtacagagtgaaacccaaaggagcataaaaatttagtgaagataaacatccaggattctgaaccattacaaaagtaaatacattccattcacaagagcatccaacaaataaaacatttaggaataaatttaacaaagaagtgtaagacttgtacactgaaaactgcaaaacattgctgacaaattaaagaagacctaaataaatgatcatatctcatgctcatggattagaagacttaatattgttaagatagcaatactccccatatcggtccacagattcacaataatccctgactgatatcgcttagatgtttatccccgccaaatctcatgttgaaatgtaatccccagtgttggaggtgggacccagtgggaggtgtttgggtcatgagggtgcatcccttatgaatgtcttggtgctgtcctcatgataacaagtgagttcttgctcagttcccatgagatctagttgtttaaaagagtctgggacctcgcactcctcttgctcccactctcgtcatgtgacaatgctagctccccctttgccttccaccatgattggaagcttcctgaggccctcaccagaagcagatgctggtgctatgctccatgtacaatctgcagaaccataagccaattaaatctcttttctttataaattacccagtctcaggtgttcctttatagcaatgcaaaaatggactaacacttttaacaaaatccttactggctctttcaaagaaattcaccagctgatcctaaaattcatacagaaatgcaagggacccagaatagccaaaacaatcttgaaaaagaggggcaaagttatagaaatcacacttcccaatttcaaaacttactaggaagctataataaccaatagaattgctatctcagaaataaacctttacgtttatggtagatcatagacctacttgcaagagctaaaactataaaactcttagaaaaagaaaacaggaatacaactttataatcttgagttaggcaacaatgtcttatatataacaccaaaagtacaagcaataaaaaaaattgatgaactggacaatcaaaacttaaaccttttggactccaaaaaaaaaatcattaagaaggtaaaaagacaacacacagaatggaagaaaatgtttgtaaaccctatatccaataaggggcttatatccagaatctattaaaaaaaaacttactacttaataataaaaagacaatcctgtttttaaaataggcgaagagtctaaatagacatttctccaaagaaaaaatacaaatggtcaataagcacataaaatgacattctatcataaatataatctaaattattaaagcataattaaagatgtacagaggttttagtaaggacctttgaataagttttttttattatttaaaaataggcacatttcttgtgtagtcaaaaacacaaggctaaaaacatacctgcagaggggaccaaaaaaaaatcaatgtgtatgtatatgtactggaaactgtcactttaataactgtaaaaactagtgagtaattattataatgaagcagtagaaaagtaacatttacatacattgcagctaacttctctccttggggggaatatcaagatcattaaaagggtgggggtagagggtgtcgatcttgttcaccatgctgccccaaaaccatgagcagaatgcatctctctcggaaatccctggagaccccatagagctcattttgtagctaaaagcaaactctgagctataaatattagttgtcttttgcacaaaaattaacagtagctttaattgtcctttctttttacttttcccaccaatgatacattcagtctgagaaacttgagattcttaacaagtaagaggtcaaatatttttgaaattccttgtattcttagttcctttacttcagacagagtcggcaaactatggaaacaagccaaatccagcctgccctgtttatgtgcagcctacaagctatgaatgttttttatatttttaaaggttgggaaaaaatcaaaagaataatattttatgacatgaaaaattatataaaatgtaaatttcagtatacataaataaagctttattggaacacaaccataactttttgtttattgcttacatatttctatagctattttcattcttcaacacacagagttaaatacttgcaacaatgtacggcccacaaagcctgaaatatttactttctggcctttcacagagaatgtttgctgatccctcatctgagataaatgaactaataaaattcataatctgtttttttaaaaagcacttcatttttaaaaagttcatacaactaacaagggtctccattttgatatatataaatgtggccctaaaaattctttttcaaaaattatttagttggctttcatatcttaagctgaatacatggaccttgcctgaaaatcccagacaacataaagttgagtttatcccttaaaagaataaaatttgacccagcagtctttcagcttcagtattcatatatctaataatattagcatctcaggaatttcccatatgcctcagttaaatagttccccgaagaatactcagccagctctaaataatgctcccagtgtaatatcaaaaggaggtatgaattttctcctcaccccaaagcataatagtgaaaaactatactgcaggagtcaacagccagctcatctaccttgttcgctacctttcaatgaaatcctgagcaagtcacataattttttggtatcaatatccttattatgcaaacacaaagattatggaaacacatagaataaagaaaataggtgaaataaagaaataaaggtgaaatgaagaaagaataaagaaattatttaaagaataaagaaattctttttttaaagaataaattatttaaattaagaattctttatttaaagaataaagaaattcttttattaaagaataaagaaatttctttaccgtagaataaagaaatttctttattcatagaataaagaaataggtgaaataaagaaaataggtgaaagcctttagttctcagagaaacatactaaataaacatggagtttttaaaaggcaaaagtatcctcactgctgtgttcatattttatatattttagtgtgaagatttatcacgtcaaaatcaaggctactcccatgaaacttacagaagaatttcccatggagcttcagcaaactttcgtgtctcagtctatcataaatctcagcttgctattgacagggaaaggaggcagagaagagctgggtagaggagggtgtggttcctggcgagggctccacctccaggcctgtgcccacagacctaggtgaggacaggcactcctgactttgcacccaaatgttgcatttcccaggactgtcctggcctgccactccccagtcctgtgcctgtaaaaactcccgagactctggcaggcagacacacaagcggctgcacgtggagagaaacacatcttggtggaggaatacacaagcagctgaacattgagagggcgtcgagaggaggagatcggtggaagaagacacaagtggctggacgtgaagaggacatcaagagcagacccgcaggccatcgaccggtggaacgacgtggagttttactgggcagtcggagaagagtcaggcagttttctaggggaaaccatctcctttctgtctcccccacctgctgagagctacttccactcaataaaagcttgaactcattctccaagcccatgtgtgatccaattcttctggtacaccaaggcaagaaccccaggatacaaaaagccctgtccttgagataaggcaggggtctcattgagctaacgcaagccgtctacggatggctaaactaaaagagcaccctgtaacacatgcccactggggcttcagagctgtaaacattcgcccctagacactgttgtggggttggagccccacagcctgcccgtctgtatgctcccctagagatgtgagcagcggggcactgaagaagcgagccacactcccatcacacaccccctgaggaggacaagggaacttttcccgtttcactatcaatcacactattttaggggttcaactgtccataaccagtggactatcaatagaaactctcacttccaaatgcctccctcagggatgtttgaaactggtatttattaaactgggtaaatgccatagactaaagaggaaagaagaggtcaaaaatattgggtaaaaaaaggagcaatgaaaaattttggaatagaaggaggaaacggtgaagcaagtaagggaaaataagagttgctaattctttcttttgggttatcagtatagactgaatatttgatgaggaagataaaacaggagatctcattgatagccgctagtgtccaaaagcaaagaaaaatgagaagtattatctcatataatgtgctagcacacagaaaaggataacaacgcacattcaagaatacaatacgacaattcaaggatgcatttgatattacaggtccatgcatatttaagtacaatcattccttattttatagtttcttataggttttttttcgttgttagaggttagacctgaaccagccaaatccttgagccaacttggaataatgattatatgattttcatgcaatactattttttttcttcaacttttaagttcaggggtacatgtgcaggatgtacaggtttgttacctgtacatcgacgccctctcaatgttcagctgcttgtgtattcctccaccaagatgtgtttgtctccacatccagccacttgtgtgtctgcctgctagagtctcgggggtttttataggcacaggactggggagtggcaggccaggacagtcaggtaaatgtgtaccatggtggtttgctgcatagatcatcccatcacctaagtattaagcccagcacccattatcaattattcctgatgctctccctccccaacccaacccctgacaggacccagtgtgtgttgttcccgccttgtgcccatgtgttctcatcactcagctcccacttatatgtgagaacatgcagtgtttggttttctgttcctgcattagtttgctgaggataaggacttccaattccattcatgtccctgcaaaggacatgatctcatttctttttatggctgcatagtattccatgatgtatatgtaccacattttcttcatccagtctgtcattaatggatgcaatactattttgagtggattcttcatcaatttttttctttggcccttttttaaccccgtttttttaccacccaatctctttcattgccagaaacttctcttgttctgtgatcttaaattttcactgatttgggggcactggtgcaccttttagttttgtctttcaactgtgatttcaatttgagcaggaatttagtatggaatgtgtgtgtgataaaaacagttttgctgtaaagaacatgctcttcaataaagttcaacaactcctttctctccataatagaccctcaggcacttagacacactagctcctaaaaatcgtttgtaactataccccttaaatctatatttaataataatatattatgtacaaaatttaattcattttacctaggtttatacatactaactggtactttgaagtcaagtcattctttctaaatgcttcttttattagaaatgagttcataagctgtgatcctggaaaaacatcttgagtcactatcgaaatctaaacattttaaagtcctcttaaaatgttactaattaactgagagagtctttagcccaaagcgtctcctattagtgtgggagaaataatagtaatctggacattaagaaacctgcattttacttattagcagcatttgaggaatggcatttaaaaatacgggaaataagattattctctgggaattaaactgcagtcatcacttacacaatggatggaagagatatacaaaaaaagaaaaagaattttcttctcacattcaagaatacaatagaaatgaattatattttgagggtcaaatgaccagtcatctttttttcttttcttttttttttaattatactttaagttctagggtacatgtgcataatgtgcaggtttgttacgtatgtatacatgtgccatgttggtgtgctgcacccattaactcatcatttacattaggtatatctcctaatgctatccctccccgttcccccaaccccacgacaggccccagtgtgtggtgttccccaccctgtgtccaagtgttcccattgttcaatgaccacctatgagtgagaacatacagtgtttggttttctgtccttgtgatactttgctcagaatgatggtttccagcttcatccatgtccctacaaaggacatcaacccatccttttttatggctgcatagtattccatggggtatatgtgtcacattttcttaatccagtctatcattgttggacatttgggttggtttcaagtctttgctattgtgaatagtgccacaataaacatacgtgtgcatgtgtctttgtagcagcatgatttataatactttggatatatacccagtaatgggatcactggatcaaacagtgtttctggttctacatccttgaggaattgccacactgtcttccacaatggttgaactagtttacagtcccaacagtgtaaaagtgttcctatttctccacatcctctccagcacctgttgtttcctgactttctaatgatcgccattctaagtggtgtgagatggtatctcattgtggttttgatttgcatttctctgatggccagtgattgtgagcattttttcatgtgtctgttggctgcataaatgtcttcttttgagaagtgtctattcatatccttcacttactgtttgatggggttgatttttttcttgtaaatttgtttaagttctttgtagattctgtatattagccttttgtcagatgggtagattgcaaaaattttctcccattctatacgttgcctgttcactctgatggtagtttcttttgctgtgcagaagctcttcagtttaattagatcccatttgtcaattttggcttttgttgccattgcttttggtgttttagacatgaagtccttgcgcatgcctatgtcctgaatggtgttgcctaggttttcttctagggtttttatcgttttaggtctgacatttaagtctttaatccatctggaattaatttttgtataaggtgtaaggaagggatccagtttcagctttctacatatggctagccagttttcccagcaccatttattgaatagggaatcctttccctatttcttgtttttgtcaggtttgtcaaagatcagaatattgtacatgtgcggtattatttctgagggctctgttctgtttcattggttgatatctctgttttggtaccagtaccatgctgttttggttatgtagtcttgtagttcagtttgaagtctggtagtgtgatgcctccagctttgttcttttggcttaggattgtcttggcaatgcgggctcttttttggttccatatgaactttaagtagtttttttccaattctgtgaagaaagtcattggtagcttgatgcagatggcattgaatctataaattaccttgggcagtatggccattttcacgatattgattcttcctatccatgagcatggaatgttcttccatttgtttgagtcctcttttatttcgttgagcagtggtttgtagttctccttgaagagatccttcacatatcttgtaagttggattcctaggtattttattctctttgaagcaattgtgaatgagagttcactcatgatttagctctctgtttgtctgttattggtatataggaatgcttgtgatttttgtacattgattttgtatcctgagactttgttgaagttgcttatcagcttaaggagattttgggctgagacgatggggttttctagatatactatcatgttatctgcaaacagagacaatttgacttcctcttttcctaattgaataccctttatttctttctcctgcctgattgccctggccagaacttccaacactatgttgaaaaggagtggtgagagagggcatccctgtcttgtgccagttttcaaagggaatgcttccagtttttgcccattcagtatgatattggctgtgggttttcatacatagctcttattattttgagatatgtccaatgaatacctaatttattgagagtttttagcatgaagggttgttgaattctgtcgaagccttttctgcatctattaagataattcatgtggtttttgtctttggttctgtttatatgatggattacatttattgatttgtgtatgttgaaccagccttgcatcccagggataaagcccacttgatcatggtggataagctttttgatgtgctgctggattcggtttgccaatattttattgaggatttgtgcatcgatgttcatcagggttattggcctaaaatcctctttttttgttgtgtctctgccaggctttggtatcaggatgatgctggcctcataaaatgagttaaggaggattccctgtttttccataaattggaatagtttcagaaggaatagtaccagctcctttttgtacctctggtagaattcaggtgtgaatccatctggtcctggaatttttttgtttggtaggctcttaattattgcctcaatttcagagcctgttattggtctattcagggattcaacttcctcctggtttagtcttgggagggtgtatatgtccaggaatttatccatttcttttagattttctagtttatttgcttagaggtgtttatagtattctctgatggtactttgtatctctgtgggatcagtgttgatatcccctttatcattttttattgcatctatttgattcttctctcttttcttctttattagtcttcatagcagtctatcaattttgttgatcttttcaaaaaaccagctcctggattcattgattttttgaagggttttttgtgtctctatctccttcagttctgctctgatcttacttatttcttgccttctgctagcttttgaatgtgttcgctcttgcttctctagttcttttaattgtgatgttagggtgtcaattttggatctttcctgctttctcttgtgggcatttagtgctataaatttccccctacacactgctttaaatgtgtcccagagattctggtatgctgtgtctttgttctcattggtttcacagaatatctttatttctgccttcattttgttatgtacccagtagtcattcaggagcaggttgttcagtttccatgtagttgagcagttttgagttagtttcttaatcctgacttctagtttgattgcactgtgaccagtcatcttaaagtaacagaatggatcccaggcttcaatggctaaccttgactataaattaactaaaagttttggtatatctaaaaaaaggaattatcaatcaaaaagggactgtgtcaaccatggaaaaaagaaagttggtgatattcatccaaacagtttccaacagagtaagagctttatataataaaccatacatagtagaaccccattggtaagattatctctacagaaaggatagatgaatctgatgatttttaactttcaccattaagcattcaatttatccagcctcctttgttctatctctatgctcactaagcaatcttctgattattatttatgttgcctatattgatccatctacagtgagagaacatattggttgtgtgggtgtactttgttctgcataactttttcattataaatttaaaataggttctgattttacatcttagcttcatgatcttagttaatgtgagtatactcctgagagacaaatctggtcttggcatatgtatctgaaagggatctcagtttcaaataacagaatctattctaactaatttaaaaggtaaaggaatttgttcagggttattgggttgtttacagaatttctgcaaggcccagaaaagccaggtttgaatgatattaaggcaggaacatcaaccaagaacaacttctaatgccaccatagctctattttaggtagaaaccccactactaccaccactcattactcaacacctatgatactaggaactgggcctgagaaactctgtcagggctgccctaaaagaacaaatgcttctgccactagattgcaacaagaccctatctctctaaacatggccactctcatactgcttacctcatccttccaagtttcacaggtatgcatcttttttgcagaacctaagccatattcccaaatgcaagaagagtcttggaaatgtatctttttatctttccaacctttctaaacatggccactctcatactgcttacctcatccttacaagtctcacaggtatgcatcttttttgcagaacctgagtcatagtcccagatgcaagaagagccttggaaatgtattttttatctttccaacctctgtagtatggtccctcccaaatatactccactagaaaggagctggaataggtcaagtgaatcttaccttattaaaactattatactgcttaaaacacttttaaaactgtgtcatgtttgacacctcttccacccacccctttttctctcagttctaccatgcttaaaaataggcttttaatatcaattctattcttcactgagattgctataaagatcttgccattgatatatgtcaaagtgttctgaaaaagcatgaaactatctgaatgcggctggcagccaagatggccgaataggaacagcgccggtctacagctcccagcgtgagcgacgcagaagacgggtgatttctgcatttccatctgaggtaccgggttcatctcactagggcgtgccagacagtgggcacaggacagtgggtgcagtgcactgtgcgcgagccaaagcagggcaagcattgcctcactcgagaagcgcaaggggtcagggagttccctttcctggtcaaagaaaggggtgacagatggcacctggaaaatcgggtcactcccaccctaatactgcgcttttccaacgggcttaaaaaatggcacgccaggagattatatcccgcacatggctcggagggtcctacgcccacggagtctcgctgattgctagcacatcaggctgagatcaaactgcaaggtggcagcgaggctgggggaggggtgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcagtgcttctcccagcacgcagctggagatctgagaacaggcagactgcctcctcaagtgggtctctgactcctcacccccgagcagcctaactgggaggcaacccccagtaggggcagactgacacctcacacggctgggtacccctctgagacaaaacttccagaagaatgatcagacagtagcattcacggttcacgaaaatacgctgttctgcagccaccgctgctgatacccaggcaaacagggtctggagtggacctctagaaaactccaacagacctgcagctgagggtcctgtctgttagaaggaaaaataacaaacagaaaggacatccacaccaaaaacccatctgtacatgaccatcatcaaagaccaaaagtagataaaaccacaaagatggggaaaaaacagagcagaaaaactggaaactctaaaaagcacagtgcctctcctcctccaaaggaacacagctcctcaccagcaacggaacgaagctggacggagaatgactttgacaagttgagagaaggcttcagacgatcaaactactccgagctacaggaggaaattcaaatcaaaggcaaagaagttaaaaactttgaaaaaaatatagacgaatgtacaactagaataaccaatacagagaagtgcttaaaggagctaatggagctgaaaaccaaggttcgagaattacgtgaagaatgcagaagcctcaggagccgatgcgatcaactggaagaaagggtatcagtgatagaagatgaaatgaatgaaatgaagcgagaagggaagtttagagaaaaaagaatgaaaagaaatgaacgaagcctccaagaaataggggactatgtgaaaagaccaaatctacgtctgattggtgtacctgaaagtgatggggagaatggaaccaagttggaaaacactctgcaggatattatccaggagaacttccccaatctagcaaggcaggccaacattcagattcaggaaatacagagaacaccacaaagatactcctcgagaagagcaactccaagacacataattgttagattcaccaaagttgaaatgaaggaaaaaacggtaagggcagccagagagaaaggtcgggttacccacaaagggaagcccagcagactaacagcggatgtctcggcagaaactctacaaaccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaacaggcctgccctaaaacagctcctgaaggaagcactaaacatggaaaggaacaaccggtaccagctactgcaaaaacatgccaaattctaaacaccatcgaggctaggaagaaactgcatcaactaacgaggaaaataggcagctaacatcataatgacaggatcaaattcacacataacaatattaactttaaatgtaaatggactaaatgctccaattaacagatacagactggcaaattggataaagattcaagacccatcagtgtgctgtattcaggaaacccatctcttgtgcagagacacacataggctcaaaataaagggatggaggaagatctaccaagcaaatggaaaacaaaaaaaggcaggggttgcaatcctagtctctaataaaacagactttaaatgaaaaaagatcaaaagagacaaagaaggccattgcataatggtaaagggatcaattcaacaagaagagctaactatcctaaatatatatgcaccaaatacaggaggccacagattaataaagcaagtccttagagacctacaaagagacttagactcccacacaataataatgggagacttaaacaccccactgtcaacattagacagatcaacgagacagaaagttaacaaggatatccaggaattgaactcagctctgcatcaagtggacctaatagacatctacagagctctccaccccaaatcaacagaatatacattcttctcagcaccacatcgcacttattacaaaattgacaacatagttggaagtaaagcactcctcagcagatgtaaaagaacagaaattataacaaactgtctctcagaccacagtgcaatcaaactggaactcaggatcaagacactcactcaaaactgctcagctacatggaaactgaacaacctgctcctgaatgactactgggtacatgacaaaatgaaggcagaaataaagatgtcctgtgaaaccaatgagaacaaagacacaacatactagaatctctgggacacattcaaagcagtgtgtaagggaaatttacagcaataaaagcccacgagagaaagcaggaaagacctaaaattgacaccctaacatcacaattaaaagaactagagaagcaagagcaaacacattcaaacgctagcagaaagcaagaaataactaagatcagagcagaactgaaggaaatagagacacaaaaaaccctgcaaaacaatcaatgaatccaggagctggttttttgaaaggatcaacaaaattgatagactgctagcaagactaagaaagacaaaaagagagaagaatcaaacagatccaataaaaaatgataaaggggatatcaccgccaatgccacagaaatacaaactaccatcagagaatactataaacacttctacacaaataaactagaaaatctcaaagaaatggataaattcctggacacatacaccctcccaagactaaaccacgaagaagttgaatctctgaatagaccaacaacaggatctgaaattgtggcaataatcaatagcttaccaaccaaaaagagtccaggaccagatggattcacagccaaattctaccagaggtacaaggaggaattggtaccattctttctgaaactattccaatcaatagaaaaagagggaatcctccctaactcattttatgaggtcagcatcatcctgataccagagccgggcagagacacaaccataaaagagaattttagaccaatatccttgatgaacattgatacaaaaatcctcagtaaaatactggcaaactgaatccagcagcacatcaaaaagcttatccaccatgatcaagtgggcttcatcgctgggatgcaaggctggttcaacatacacaaatcaataaaggtaatccagcatacaaacagaaccaaagacaaaaccacatgattatcttaatagatgcagaaaaggcctttcacaaaattcaacaacccttcatgctaaaaactctcaataaattaagtattgatgggacatatctcaaaataataagagctatctatgacaaacccacagccaatatcatactgaatgggcaaacactggaagcattccctttgaaaactggcacaagacagggatgccctctctcaccactcctattcaacatagtgttggaagttctggccagggcaatcaggcaggagaagtaaataaagggtattcaattaggaaaagaggaagtcaaactgtccctatttgcagataacgtgatagtatatctagaaaaccccatcatctcagcccaaaatctccttaagctgataagcaacttcaacaaagtctcaggatacaaaatcaatgtgcaaaagtcacaagcattcttatacaccaataacagacaaacagagagccaaatcatgagtgaactcccattcacaactgcttcaaagagaataaaatacctaggaatccaacttacaagggatgtgaaggatctcttcaaggagaactacaaactactgctcaatgaaataaaagaggatacaaacaaatggaagaacattccatgctcatgggtaggaagaatcaatatcatgaaaatggccatactgcccaaggtaatttatagattcaatgccatccccatcaagctaccaatgactttcttcacagaattggaaaaaactactttaaagttcatatggaaccaaaaaagagcccgcatcgccaagacaatcctaagccaaaagaacaaagctggaggcatcacactacctgacttcaaactatactacaaggctacagtaaccaaaacagcatggtactggtaccaaaacagagatatcaaccaatgaaacagaacagagccctcagaaataataccacacacatctacaaccagctgatctttgacaaacctgagaaaaactagaaatgaggaaaggattccctatttaataaatggtgctgggaaaacaggctagccatatgtagaaagctaaaactgaatcccttccttacaccttatacaaaaattaattcaagatggattaaagatttaaatgtcagacctaaaaccataagagccctagaagaaaacctaggcattaccattcaggacataggcacaggcaaggacttcatgagttaaacaccaagagcaatggcaacaaaagcctaaattgacaaatgggatctaattaaactaaagagcttctgcacagcaaaagaaactaccatcagagtgaacaggcaacctacagaatgggagaaaattttttcaatctacccatctgacaaagggctaatatccagaatcgataaagaacttaaacaaatttacaagaaaaaatcaaacaaccccatcaaaaaatgggcaaaggatatgaacagacacttctcaaaagaagacatttatgcagccaacagacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacactttaacactgttggtgggactgtaaactagttcaaccattgtcgaagacagtgtggcgattccttaaggatctagaactagaaataccatttgacccagtgatcccattactgggtatatacccaaaggatcataaatcatgcttctataaagacacatgcacacgtatgtttattgtggcactattcacaatagcaaagacttgaaaccaacccaaatgtccaacaatgatagactggattaagaaaatgtggcacatataatccatggaatactatgcagtcataaaaaaggatgggttgatgtcctttgtagggacatggatggagctggtaaccaccattctgagcaaactatcgcaaggacagaaaaccaaagaccgcatgttctcactcataggtgggaattgaacaacaagaacacttggacacagggtggggaacatcacacactggggcctgtcatggggtggggggaggggggatggatagcactgggagatatacctaatgtgaatgatgagttaatcggtgcagcacaccaacatggcacatgcatacatatgtaacaaacctgcacgttgtgcacatgtaccctagaacttaaagtataacaactgtatatatatgcatatatgtgtgtgtgtgtgtatatatatatatatatatatatatatatatatatatatatcactatgatcaggtgggttttatatcgtgatgcaaggatagttcaacatggccaatcaataaaacctgatacattacataagcagaatcaagggaaagaaacatatgttcatctccatagatgcagaaaaagtatttgagaaaatacagtatcccatcatgatacaaactctcaacaaagtgggcatagaaggaatctccctgaaaataagaaagaccatatacgagaaacctacagttaacatcatactgaatgggaaaaagttgaaagcattttctctaagaactggaacaagacaaggatgcccactttcgccattcctattcagcatagtaccagaagtcctagccagagcagtcaggcaagacgaagaaatgtaaggcatccaaattggaaaagagaaagtcaaattatccctgtttgctgatgatatgatcttatatttagaaaaccctaaagactccatacaaaaactcttagatttgataaatgaattcagtaaaatttcaggatacagagtcagtgtacaaaaatcagtggtgttcttatacaccaataatgatctatctaggaaagaaatcaagaagtaaatcttatttacaatagctacaaaaagatatgtagaaataaatttaaacaaggaggtaaaagatctctacaaggaacactagaattcacagataagaaattgtagatgacacaaacaaatggaaaaacatcccatgctcatggatcaaaataattagtattgttaaaatgaacatactgcccaaagcaatctacaaattcaatgcaatccttatcaaaatactaatatcatttttacaggattagaaaaaacaatcctaaaattcatacagaaccaaaaaacagcccaaatagtcaaagcaatcctgagcaaaaagaacagaatagctattattttttttcccacacagttcactgatgtatagaatggctattattaaaaggacaaaaaataacagatgttggcgaggatgtggagaaaagaaaacccttatattctgttggtagaaatataaattagtacagcctctatggaaaactgtatggagatttcccaaaggactaaaaatagaactaccattgcatccagccatccactactgaatatctacccaaatgaagccaatatataaaaaagataccttcacttgtatgtttattgcagcactatttacaatagcaaagatatgcaatcaaactcagtgtccatcaatagatgaatggataaagaaaatgcagtatatatatattatatatatatacacacacaaacacacacacacacatatgtgtgtgtgtatatatatatatatatatatatatatatacaaaacctaggcattaccattcaggacataggcataggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaattttcgcaacctactcatctgacaaagggctgatatccagaatctacaatgaactcaaacaaatttacaagaaaaaaacaaacaaccccatcaaaaagtgggcaaaggacatgaacagacacttctcaaaagaagacatttatgcagccaaaaacacatgaaaaaatgctcatcatcactggccatcagagaaatgcaaatcaaaaccacaatgaggtaccatctcacaccagttagaatggcgatcattaaaaagtcaggaaacaacaggtgctggagaggatgtggagaaataggaacaattttacactgttggtgggactgtaaactagttcaaccattgtggaagtcagtgtggcgattcctcagggatctagaactacaaataccatttgacccagccatcccattactgggtatatacccaaaggactataaatcatgctgctataaagacacatgcacatgtatgtttattgcggcactcttcacaagagcaaagacttggaaccaacccaaatgtccaacaatgatagactggattaagaaaatgtggcacatatacaccatggaatactatgcagccataaaaaatgatgagttcatgccctttgtagggacatggatgaaattggaaatcgtcattctcagtaaactatcgcaaggacaaaaaaccaaacaccacatgttctcactcataggtgggaactgaacaatgagaacacatggacacagaaaggggaacatcacactctggggactgttttggggtggggggaggggggagggatagcattaggagatatacctaatgctaaatgacgagttaatgggtgcagcacaccagcatggcacatgtatatatatgtaactaacctgcatgttgtgcacatgtaccctaaaacttaaagcataataataataaaataaaaaaagaaacagatgcaacaactatatttccaataaaacaagacaataaaaataagaaatgagaaaatggcaaaaaaaaaaaagaatgaaatatgtcttttgcagcaaattggatagaactgggtatcattatcataagtgaaacaagccagggacaaaaagacaaatattgcatgctttcataagtggatgctaaaaattgtgtataaatgaatgtagaaagtggaatgattgataatggagacttggaagggtgagagggttagagcggagaggatagtgagaaattggttaatgcgtacaatgtacgttacttgggtgatgaataccttgaaagccctgacttaaccactatgtaatctatgcaagtaataaaattacaggtgtaccccatatatttgtacaaagaaaaatctgtatcctttcatgtgaattatctggagcttgaatgtgcagtctaatgtctatagcctcggtagttatgcctaccagaggtagcaattccaaacagataccacgggcttcatgttcatgtatgtttactgggagaggtcttgcaaattaatggaagcttgccactgctaaactgcctcccatctatttttaattgtaggcctccaccaaggtcatcaagagtcagttggagggctaggaagattaatgtggagctttcgaatctatcagaagctaactatagctctccttcctaaatatggggttatggtattttgtattaaaagaaatgctatggtatttagtatattaatgcaggagcctcccagctgcatgtttgtagagcttaggcctacagtagttgacaacttgccccactttgcatggctcatgaatatgtctggcagggtagtggatgtagccagaaactaggggactttctctctcccttgtgagtagtaaactttgggttaaaaaatgttcacatacctcatgtgcataacatatgtacttgtgtattttttctatttatctctctttctacattttcatagttcttcatctcaatgtttgcaagactccaggctacagactgtttttttttttgcagtaggaattaggagtcaaggcttaccaccatccatattagtcagagaaaaccattacttccagaaatgattattcttggaaagtggcatcctggaagtgtacttaatcttcctatcagtatacttaggtacttaaacaacaaatggcattatagaattttcaatattgaacatttaaaatgttacctatcttctccctgattgttccagtatatatatatgtgtgtgtgtgtgtgtgtatagtacagtacatatttccttgcacgcacacacacacatatatatatgcatatttatatgcacacagacacacacacatatatatatatgcaaggaaataaattttgtcctagggaactagagattagaaaaatttttactggtgtccattttgggttacctgtattgaaagagcttttgaaactcagctatattgaatatttatttataaaagaaaatagcagttcaatttttgttaacgattcctaagtaacgggtcagctccatctacttgttcaacaatgttgcagttaggacttaggtgaaatgtttggtatttaccaccaattgctcacagcctatatatggtttcaaaggcaacagctgctgccctcattacttccatctcttactatgttggtgttgtgtgcatttaactgttattataacttaacaatgtccttagataagcattaagacacaaatgcaatattcttttcaacttggtatagcatgcttcaggagacgcagttcgttcttcatttgaaagagaatgatgaactcttgttctaacacattttaacatgcatgcattgtgtcctgtagctggcagaaagtttatggaaacatttccattgaagactgatgagataattagctacattgcttgtaaactactaattgctaaaaaaacgttcaacatggtattccataatgttctcttgaaaaatcttcagcagacttttcttttagtgcatttgatattttcagcaaactcctcagtgtcaaccattatgaggtgtgcggatgattgggaagtacttaatatgtgtgcatagccattccaatttgagttacttgatatgctggacatatagacaagctgatttaagaaataacagtaattccagtttttaaagtatgagaaattctgtaagctgtgtaccatttactttgaagtataattcaaaggtgggagcaaagatttaatgcatgttaacaggttgatttgtaagtaatgagtcctagaaactaaaatgtggcctgaaatctcagctggtaaagagtctgaaatcagaggtgtgattcttatattagccatggctctgctctccttcacagctatagcgatggcaccacagcgtagccatttcataaatgtgtgcaaaggtaacagagtgacctaaagtttatgttcacagaagatgggtctgaaaattattgttgtgttgcacattctagcattaaagagtgcattaagctattgcagttgctcagggggaggaataaaaatcttaagaatttctgtccttgactgtttcttctcatccctttcttaagtttcaaaagaagtggtgttcctttttgctctttaaaactaatctttccaatcattatctggatcttagctcatcccttctcttctcttctcgagagacttttattctacaattacctttttttctgtagcatgttcatttaccttccttttcattagttctttcttcacacatattagcttgcccctgctttacaactggcaaatattcaataacaattccactttcttttagtctactcttttcttaaactcctaatcctgttttacctgacctgttctgcttggtgtatttgttgtttaatccaattacttttgaacaattttaattctcttcaactcctgtgctgcattcgacatttatttactcatcctgaaactttccgcctttcttttagaatattatatatgaaattcttctattacttccccacatcgtctttctctttcctcattgacttcttcctcttgtctctttttttagtgttagtcttggtcctctctgtcacttcttgtttcctttcctgggagagcttcttcattctcatgatttgaattacagttgctatattgacaacttttagttctcatgtaaagttccactgccaaattctgagtgcttctcaataatttttctacattaatacatagataatcatactcatctcactcccacaaataatggccactcttgggaatgtttgatgttcaacatactagttgaaactgttcatttcttccccagtgagtagtgacacatactgtggacaacattactgctgtaaccttttactaggtggttccacctggctgttttggtattacatactcaccatgtataaactgaactcagcatcttcttcacaaggtctttacaaactttgctatctctagtgtcatctgacttgaactctcagcatatttgacatagttgattattttctctttttgaaatactgtttccttgactaatggagcactgccagtcctggtttctttttcacatctttggtaatttcttttcaatctcctttttggttcatcattttcatactggccatccagtgctggaactcctcaaagctggttcattatgtgggatagatggaaagtgaagttggaaataaacttggaatgataaatttggaataaaccttggagatccttcaatggcaagataaggatgctggggcatccttacaaaattttttagtcaaacagtaacaggactaagtctatgttttaggaagatttatctggcattaatatgtggaagataggttacatctccacagtgcctctctaatattaatgatgataataataactacaataatactgatttgtatttatgtgtcttgatgagataatgcacataaggcaaataaggagactcaaatctagaaagaaaaaatgatttgcctagagctacctggttagttattcacagagttgggattgcctttcaagtttatactaaagaaatatttgttgactgtttgataattgtgtatctccatttccctttattttttctgtcatttaatatatgttactctggtcactctaagtatctttgaaattgcttgagaataattctctagtacagcctcaaactgtgatccttggaaaacaagtgtttctagaaatgttaagaactcttctgtaagaaaaacattaagtaaattcataaaactcaattaaaaattctaagcatgggttcattactagataacttctcagtcaacattcttaaaatgctgaattgtattgcaaatctctgcgagtagattataatagactatagtttatacaggctgggtgcccaagtagcagaacctaagatggaggttcttgtgcaactgatttactggagtcccgtcaagtgaaatctacgagggggtgagggaagcaggagagggcagagaagaagctgagagaagttgaactaaagcttggactgtacgggatggcaaacattgactgcatgtggccgctgagcacttgaaatgtgcagagtgtgactgaggatctgaatttctaattttatctaattgtaacttaaattttaaaaaccaatacttcattcagctattgaaaaactttaaattatgagtatgtgaatcatctttttcaactataagtttttatgacatctaaatacagatcaagtatttctgatgaaaatttagtatctgaattcagatgttttataagggtaaaatacataatggatttcaaatactttgtatgggaaaatgtaaactgtcaataatctttttatattgattgcatgttgaaatgatatattttagatatgttggattaatcaaaatacagttttaaaaccaattttacctttttttacattttaaatatttgatttttttctatttacttaaattttttttgtaaatgctaataatttttaaaatatgactaccaaaatatttaaaatcacatatgaggctcacattagcttttctactggaaagtgctgagctaaagtatagctctaactgatcccataggaggtctggagagtgaatcgcaccagaatgatctccccttaaggcaacaggtcagtcttttgtgtcccagggtcagccagtcattggttgatcctttatcccctcgaagcataacttccaggcctaatgcagtttggaattttcgagagattctttcataaactttaccaccagcctgttgtgtgctatattggatttgatgagaccaccatacaatcagtaagtctcaaaggatggaaatcaccaaactccattgattttctatgtaatattttatttcctaagatgtctgcctttctcaggcagttaagcatgaaactcactacacagaaatagcaacatttagcatatctgttctgatgcttgtttctgagttacctaagtgctaaacaactatcaataattttgatttctcttgagaaagacttctagattaggtgccccaaggagaattttatgatcgaaagctatgttgggccccagtagctcatgcctgtaatgccagtactttgggaggccaaggtagatgaatcacttgagtccaggagttcaagaccagcttgggcaacatggcaaaaccttgtttctacaaaaagtataaaaagttagcttggcatggtggtgcacacctacagtcccagctactcaggaggctgaggtgggaggatcacttgagcctgagaggttgaggctgcagtgagccgtgattgtaccactgtgctccagtctgggtgacagagtgagaccctgtgtcaaaaataaaagtaaaaaaataaatagaataaaagctatgctgctctcctacgccttttagatcgatgtgattatcatgacatcattacgaattggtgtatagacaatgatgggattaggatacagtcaattcattggcattcaaagaaatgggaaaagcccagtgtccctacgaccaacccccaaaaaaaatttcctcaaaaccagagataaaatttgcttcctctttcagtttgcaagcatgcagcctggacagaaaaggaagcaagtgcaaaacttgcttggagaagggtgactgataagtcttgaggtacatggaagagacaacattccatagcttatgttttcttttttcacccccttgaaatcagactatgagacagagaacaggtgccatctccctatcttatgtgaactgacaggattgaacacatattcccgggaatatctcagcactcctaaaaaataatttcagaaacatttgtaaaagctgaaaagaagaataaaacactggcatatgagatgaagacagaaggttagatagactacagaaaatcaagtattatattagataagaaagttgaaagtcaagtccttccctttccttcccttcccttcctctctccctccctcccttcctccctccttccctctctccttccctccctctatccttcccttccctcaacacttaatacattatcacaattaaaaatatattgtactatgtatcaaatgctgataatctcattaaaaataagttctgattactgacttcaaggaacttcagtataacttagttttaggaaagtaaatgagaataattatagcagatgaaaatgttcaagatgttatagtacctttaaatataaaagtgttaagagagtacatgtggaatggtaagaatgaagaaggctaattgataattttccaggagttgaagttcagttcagatctataaaaattttagatcaaaatatgcatatcataaaacattaaacagagcagaagagcttatgatgaaaagcaataatcttttgccctgctccttgctactttcaatccaacaccctaggaaaaacctcctttgcttccagtcccacaatctggaggaagcaggtttgattttagatcttctggtgcttacttcataactttaagtcgtatgcttatatctcttttctttgattgatttatttaaggaattatctatttactccctacaatgaaatatgaaagttttgttcccctacctctgtgtccttaccctttcttccttccaatgtttgataatttgaattattttttgttttattattatccctctgttttgtattctatcatttttaattagtgtcctgaccactctttgtgtatagtaagactaacagcatccattccacttcctccccctttacttctgcattccacctttcccttctgttttctgtcacttcaaattgtattcttacattgacaaggttgttaactttttttttttttttttttttgagacggagtctcccactgtcgcccaggctggagtgcagtggtgcgatctctgctcaccacaacctctgcctcctgggttcaagctattctcgtgcctcagccttctgacaagctgggactacaggcacccaccgccatgcccggccaatttttgtatttttagtagagatggggtttcaccatgttggccaggctggtctcgaactcctgacctcaggtgatccacctgcctcggcctcccaaagtgttgggattacaggcatgagccaccaagcctgaccaaggttgttaacattttaattctgatatgcaaccataatgaagtcatctgcatttgttcgttagctaatagtaaaagttgaaaatcacagtgcaccattaatgttactgtgactctatacattttatttagtacagggtgatgtaggatactgaaatcatatcttcttctccaaggacccaatgtcacaacccctgggccactcagaggggaatgatttatgatgaaggtcaaatagattctcttttctattgcttaaagttgtgctacactgatctagtttatgtttgggttatgcgtttcctatatatattttttgttttctctggaggttctgaatcttgatcatagcctaaatttggtctctctttcaatcataataactattttgtgaagtcttcttctttttttcccccatagagatatttcttctgaaaccgtatgtcgtcctttcaattgtgtgttttgagacatctctggattaggcacaccattttatttatcctatgtctttctgtttctggcattttccctctttcttgccataaaacagcttttctctggggccatactccccagataatttcctcaaattatgttgtgaaaaaaagccctcattttatgacttggggttaagcgttgagctgttggcaaacagtaatagagaaagtgacagggagcacagcatttcacatataggaattcaagtgatcacctcagttttcagacccactgctcatttctgccttgtatcatacttgcctactccaagccagagattctttggattctagtgggcagagtgactctgacatcctctgcagactcctcatatcatattctaaactgtagctttctcttcttgttttcatctgtcaacacccttctgttagctttccttcttcagaaggctctcagctactgttggctccccttaacaatcttgttatggttgtattcctttgctgtagtttctctatttctgtctctgtgaagtctggagaaagacttgattaaaagagctcggggtgccattttgaaaaggactgatacacccagtggacctcctagtcaagggaatggtctgagcaaagatagattagtagagttaaaaggattatggtaaatagttcacctgaaacagagaatgaatcaagtgaaagtaaacactttaggacttgctgattcaaagttgaacccacccttagacagaaaagattgcattgatatgtgaggaatcagggagcaaccttaagttcttaagcagccaagtgttattatacatagactttagcaggctgggcttagttatttaaaagcatgaagcttctgaaggccatttcctgggcaggtttctgtaaaaagtaaacagttgtttacttttacatttcaggtttaattttaagccttgaccttgagagtcatttgacctaagtaaatagatgaattatctgaagtatctgggaatttatttaactactttaaatggccacatacaaatataatgagaggaggcattattgtatagttgttaatagttttccttaccccctctactataattgttgtataaaatctaaagtttttagttccatgagtggtacacggtaagctttcaaaaattagtaattataagagtgttctcttgcattcagatagtttctttattttattttattttattattattatactttaaattttagggtacatgtgcacaatgtgcaagttagttacatatgtatacatgtgccatgctggtgtgctgcacccattaacttgtcatttagcattaggtatatctcctaatgctatccctcccccctccccccaccccacaacagtccccagagtgtgatgttccccttcctgtgtccatgtgttctcattgttcaattcccacctatgagtgagaacatgcggtgtttggttttttgtccttgcaatagtttgctgagaatgatagtttccagcatcatcgatgtccctgcaaaggacatgaactcatctttcttatggtgtcatagtattccatggtgtatatgtgccacattttcttaatccagtctatcattgttggacatttgggttggttccaagtctttgctcttgtgaagagtgccacaataaacatacgtgtgcatgtgtctttatagcagcatgatttatagtcctttgggtatatacccagtaatgggatggctgggtcaaatggtatttgtagttctagatccctgaggaatcgccacactgacttccacaatggttgaactagtttacagtcccaccaacagtgtaaaattgttcctatttctccacatcctctccagcacctgttgtttcctgactttttaatgatcgccattctaactggtgtgagatggtatctcattgtggttttgatttgcatttctctgatggccagtgttttggctgcataaatgtcttcttttgagaagtgtctgttcatgtcctttgcccactttttgatggggttgtttgtttttttcttgtaaatttgagttccttgtagattctggatattagccttttgtcagatgagtaggttgtgaaaattttctcccattttgtaggttgcctgttcactctgatggtagtttcttttgctgtgcagaagctctttagtttaattagatcccatttgtcaattttggcttttgttgccattgcttttggtgttttagacgtgaaacacccatgcctatgtcctgaatggtaatgcctaggttttgtatatatatgtatgtgtatatatatacacacatatgtgtgtgtgtgtatgtgtatatatatacacacatatgtgtgtgtgtgtgtgtgtgtatatatactacattttctttatccattcatctattgatggacactgaggttgattgcatatctttgctattgtaaatagtgctgcaataaacatacaagtgaaggtatcttttttatatattggcttcatttgggtagatattcagtagtggatggctggatgcaatggtagttctatttttagtcctttgggaaatctccatacagttttccatagaggctgtactaatttatatttctaccaacagaatataagagttttcttttctccacatcctcgccaacatctgttattttttgtccttttaataatagccattctatacatcagtgaactgtgtgggaaaaaaaataatagctattctgttctttttgctcaggattgctttgactatttgggctgttttttggttctgtatgaattttaggattgttttttctaatcctgtaaaaatgatattagtattttgataaggattgcattgaatttgtagattgctttgggcagtatgttcattttaacaatactaattattttgatccatgagcatgggatgtttttccatttgtttgtgtcatctacaatttcttatctgtgaattctagtgttccttgtagagatcttttacctccttgtttaaatttatttctacatatctttttgtagctattgtaaataagatttacttcttgatttctttcttagatagatcattattggtgtataagaacaccactgatttttgtacactgactctgtatcctgaaattttactgaattcatttatcaaatctaagagtttttgtatggagtctttagggttttctaaatataagatcatatcatcagcaaacagggataatttgactttctcttttccaatttggatgccttacatttcttcgtcttgcctgactgctctggctaggacttctggtactatgctgaataggaatggcgaaagtgggcatccttgtcttgttccagttcttagagaaaatgctttcaactttttcccattcagtatgatgttaactgtaggtttctcgtatatggtctttcttattttcagggagattccttctatgcccactttgttgagagtttgtatcatgatgggatactgcattttctcaaatactttttctgcatctatggagatgaacatatgtttctttcccttgattctgcttatgtaatgtatcaggttttattgattggccatgttgaactatccttgcatcacgatataaaacccacctgatcatagtgatatatatatatatatatatatatatatatatatatacacacacacacatatatgcatatatatacagttgttatactttaagttctagggtacatgtgcacaacgtgcaggtttgttacatatgtatgcatgtgccatgttggtgtgctgcaccgattaactcatcattcacattaggtatatctcccagtgctatccatcccccctccccccaccccataacaggccccagtgtgtgatgttccccaccctgtgtccaagtgttctcgttgttcaattcccacctatgagtgagaacatgcggtctttggttttctgtccttgcgatagtttgctcagaatgatggttaccagcttcatccatgtccctacaaaggacatcaacccatccttttttatggctgcatactattccatggggtatatgtgccacattttcttaatccagtctatcattgttggacatttgggttggtttcaagtctttgctattgtgaatagtgccacaataaacatacgtgtgcatgtgtctttatagaagcatgatttatgatcctttgggtatatacccagtaatggggtcactgggtcaaatggtatttctagttctagatccttgaggaatcgccacactgtcttcgacaatggttgaactagtttacagtcccaccaacagtgtaaaagtgttcctatttctccacatcctctccagcacctgttgtttcctgactttttaatgatcaccattctaactggtgtgagatggtatctcattgtggttttgatttgcatttctctgatggccagtgatgatgagcattttttcatgtgtctgttggctgcataaatgtcttcttttgagaagtgtctgttcatatccttcgcccattttttgatggggttgtttgattttttcttgtaaatttgtttaagttctttatcgattctggatattagccctttgtcagatgggtagattgaaaaaattttctcccattctgtaggttgcctgttcactctgatggtagtttcttctgctgtgcggaagctctttagtttaattagatcccatttgtcaatttaggcttttgttgccattgcttttggtttttaactcatgaagtccttgcctgtgcctatgtcctgaatggtactgcctaggttttcttctagggctcttatggttttaggtctgacatttaaatctttaatccattcttgaattaatttttgtataaggtgtaaggaagggattcagttttaactttctacatatggctagcaagttttcccagcaccatttattaaataaggaatcctttcctcctttcttgtttttgtcaggtttgtcaaagatcagatggttgtagatgtgtgtggtattatttctgagggctctgttctgtttcattggttgatatccctgttttggtaccagtaccatgctgttttggttactgtagccttgtaatatagtttgaagtcaggtagcatgatgcctccagctttgttcttttggcttaggattgtcttggcgatgcgggctcttttttggttccatatgaactttaaagtagttttttccaattctgtgaagaaagtcattggtagcttgatggggatggcattgaatctataaattaccttgggcagtatggccattttcatgatattgattcttcctacccatgagcatggaatgttcttccatttgtttgtgtcctcttttatttcattgagcagtggtttgtagttctccttgaagagatccttcacatcccttgtaagttggattcctaggtattttattctctttgaagcaattgtgaatgggagttcactcatgatttggctctctgtttgtctgttattggtgtataggaatgcttgtgatttttgcacattgattttgtatcctgagactttgctgaagttgcttatcagcttaaggagattttgggctgagacaatggggttttctagatatacaatcatgtcatctgcaaacagagacaatttgacttcctcttttcctaattgaataccctttatttccttctcttgcctgattgccctggccagaacttccaacactatgttgaataggagtggtgagagagggtatccctgtcttgtgctcgttttcaaagggaatgcttccggttttcgcccattcagtatgatattggctgtaggtttctcataaatagctattattattttgagatatgtcccatcaacacctagtttattgagagtttttagcatgaagggctgttgaattttgtgaaaggccttttctgcatctattgagataataatgtggtttttgtctttggttctgtttatatgatggattacatttattgatttgtgtatgttgaaccagccttgaatcccagggatgaagccaacttcatcacggtggataagctttttgatgtgctgctggatttgtttcacccttattttattgaggatctttgcattgatgttcatcagggatattggcctaaaattctctttgtttgttgtgtctcttccaggctttggtatcaggatgatgctggcctcataaaatgagttagggaggattccctctttttctattgattggaatagtttcagaaggaatggtaccagctcctcctcatacctctggtagaattcggctgtgaatctgcctggtcctggactttttttgtttggtaggctcttaattattgcctcaatttcagagcctgttattggtctattcagggattcaacttcttcctggtttagtcttgggaaggtgtatgtgtccaggaatttatccatttctttgagattttctagtttttttgtgtagaagtgtttatagtattctctgatggtagtttgtatttctgtggtatcaatgatgatatcccctttatcattttttatgcatctatttgattcttctctcttttcttctttatttgtcttgatagcggtctatcaattttgttgatcctttcaaaaaaccagctcctggattcattgattgttttgcagggttttttgtgtctctatttccttcagttctgctctgatcttagttatttcttgctttctgctagcgtttgaatgtgtttgctcttgcttctctagttcttttaattgtgatgttagggtgtcaattttaggtctttcctgctttctctcgtgggcttttattgctgtaaatttcccttacacactgctttgaatgtgtcccagagattctagtatgttgtgtctttgttctcattggtttcacaggacatctttatttctgccttcattttgtcatgtacccagtagtcattcaggagcaggttgttcagtttccatgtagctgagcagttttgagtgagtgtcttgatcctgagttccagtttgattgcactgtggtctgagagacagtttgttataatttctgttcttttacatctgctgaggagtgctttacttccaactatgttgtcaattttgtaataagtgcgatgtggtgctgagaagaatgtatattctgttggtttggggtggagagctctgtagatgtctattaggtccacttgatgcagagctgagttcaattcctggatatccttgttaactttctgtctcgttgatctgtctaatgttgacagtggggtgtttaagtctcccattattattgtgtgggagtctaagtctctttgtaggtctctaaggacttgctttattaatctgtggcctcctgtatttggtgcatgtatatttaggatagttagctcttcttgttgaattgatccctttaccattatacaatggccttctttgtctcttttgatcttttttcatttaaagtctgttttattagagactaggattgcaacccctgcctttttttgttttccatttgcttggtagatcttcctccatccctttattttgagcctatgtgtgtctctgcacaagagatgggtttcctgaatacagcacactgatgggtcttgactctttacccaatttgccagtctgtgtcttgtaattggagtattcagaccatttacatttaaggttaatattgttatgtgtgaatttgatcctgccattatgatgttagctagttattttgctcattagttgatgcagtttcttcctagcatcgatggtctttacaattggcatggttttgcagtggctggtaccggttgttcctttccatgtttagtgcttccttcaggagctcttttagggcaggcctgctggtgacaaaatctctcagcatttgcttgtctgtaaaatattttatttctccttcacttatgaagcttagtttggctggatatgaaattctggattgaaaattcttttctttaagaatgttgaatattggtccccactctcttctggcttgtagagtttctgctgagagatccactgtttgtctgatgggcttccctttgtgggtaacctgatctttctctctggctgcccttaacattttttccttcatttcaattttggtgaatctgacaattatatgtcttgtagttgctcttgttgagtagtatctttgtggtgttctctgtatttcctgaatttgaatgttggcctgccttgctaggttgtggaagttctcctggataatatcctgaggagtgttttccaacttggttccattctccccgtcactttcaggtacaccaatcagacgtagatgtggtcttttcacatagtcccctatttcttggaggctttgttcatttcttttcactcttttttctctaaacttctcttctcgcttcgtttaattcatttgatcttcaatcgctgataccctttcttccacttgattgaatcggctactgaagcttgtgcattcgtcacgtagttctcgtgccatggttttcagctctatcaggtcatttaaggtcttctctatgctgcttattctagttggccatttgtctaatcttttttcaaggtttttagctactttgtgatgggtttgaacatcctcctttagcttggagaagtttgttattcctgatcatctgaagcctttttctctcaattcatcaaagtcattctccatccagctttgttccgttgctggcaaggagctgcattcctttggaggaaaagaggtgctctgatttttagaattttcagcttttctgctctggtttcttcccatctttgtggttttatctacctttggtctttgatgatggtgacgtacagatggggttttggtgtggatgtcctttctgtttgttagttttccttctaacagtcaggaccctcaggtgcaggtctgttggactttgctggaggtccactccagaccctgtttgcctgagtatcaacagtggaggctacagagcagcaaatatggcagaacggcaaatgttgctgcctgatccttcttctggaagcttcatctcagagggtcacccagctgtatgaggtttcagtcagaccctcctgggaggtgtctcccagttaggctactcgcgggtcatggacccacttgaggaggcagtctgtccattctcagatctcaaactctgtgctgggagaaccactactctcttcaaagctgtcagacagggacatttaagtctgcagaagtttctgctgccttttgttcagctatgccctgcccccagaggtggagtctacagaggcaggcaggcctccttgagctgcagtgggcttcacccagttcaagtttcctagccactttgtttacctattcaagcctcagcaatggcagatgtccctccctgagcctcactgtcaccttgcagttccatctcaaactgtgtgctagcaatgagcgaggctccatgggcatgggaccctgtgagccatgtgcgggatataatctcctggtgtgccgtttgctaagaccattggaaaagcacagtatttgggtgggcgtgtcctgattttccaggtaccgtctgtcacggctttccttggctaagaaagtgaattccccaagcccttgcacttcctgggttaggcgatgccccgccctgcttcagctcacactccatgggctgcacccactgtccaacaagccccagtgagacgaacctggtacctcagttggaaatgcagaaatcacccatcttctgcgtcactcatgctgggagctgtagactggagctgttcctatttggccatcttggaacccttaatccagtgtaatatatttttgatgtgctgttgggttcagtttgctagaattttgttcaggatttttgcatctctgttcatcagggataatgatctgttttcttttatatgtgtcacctctggtttaggtatcagaataatactggcctcaaagaatgagttagggagaattccttcctcctcaattttttgtaaaagtttcaggaggattagaattagtgctttgtatatttggtacaatgcagctgtgaatccatctggtcctgggcttttcttttgggggagtttttttattactaattcaatattgctactaattattggtctgtttaggttttctattctttcctgcttcaatcttggcaggtggtatgtttccaggaatttctccatttcttctaggttttctagtgtgtgagtatatcaatatttataatcgtctctgatgatcatttgtatttctgtagttatcagttgtaatctcttcattctaatttctgattttacatgagtcttccatcttcttggttggtctagctagcagtttatcaattttgtttatcttttcaaaaaaccaaccttttgttttgttgatcttttgtattttttttagtctctaattcatttaattctactctgatttttgttatttcttttttcctgctaatttggggttttgtttgtttttacttttctagttccttgaagtgttattagattataaatttgtaatacttctacttttatgatgtaggtatttaatgccataaacttccctctcagcactgctttttctgtatctcacagattttggtatgttgtgttttaattttcatttgtttcaaaaaaatttttatttcaataataatttcttcattgacccagtggtcattcaggagcataatgtttaatttccatgtgtctgtatactttccaaagttcctcttggtattgatttctagttctattccactatggtctgagaagatacttgatatgatttcaattttttttaatttgttgtgactgttttgcagcctaatatatggtctatcttggagaacattccattgctaatgtaaagagtgtgtattctccagttgttgggtagagtgttctgtaaatgtctgtcaggtccatttggcctaaagttcaacttttctttattgattctctatctcaataatctgtgtaatgccaggagtagggtgttgaagtcccctaatattaccatattgctgtctctctctctttagatctagtcatatttgttttatgaatacgggtgctccaggattggatgcatgtatttagaattgttctattctcttcctgaattgatccctctatcattatataatgatcttgtcttttttatggtttttgacttaaattctgttttatctgatgcaagtactcctgcttgctttggcttctgttttgtggaatatctccccaccccatccctatttttagtctatatgtgtcttttcaggtaagtttcttataagcagcatatgcttagatcttttttaaattaattcagccagtctacatatttaagtggagcaggtagtccatttatgttcaaagttattattgatatgtaagggattttttctgtcatattgttaattgttttctagtttttaaaaaaattctttgtacccttctttttctcttattgtttatcattgtggtttggtgtaattctgtagtggttccatttgatttctttctcttcctcctttgtgagcttgctctaccaatgacttacacttttaatgtttttcatgatggtaaatgtccttttcctttcaagtttagtactctcttttttgtgtgagacaggctgtggctctgttgtccagactggagtgcagtggcctgatcacaactcactacagcctctacctcccaggctcaagtgatcctcccacctcagcctcccaagtagctaggaccagaggcatgcaccatgacacccagctaacttgtgtgtgtgtgtgtgtgtgtgtgtgtgtgtgtgtgtgtgtgtgtgtgtagagccagagtctcactatgttgcccaggctggtcttgaaatcctggactcaagtgatgctactgcttaggcttcccaaagtgctgggatcatagattggagccaccatgctcagcctaagttcaggattcccttgggaatttcttgtaggtctggtctggtggtgatgaattctcttagcatctgcttgtctggaaagtgtttatttctccttcatttatgagggttaatcttgctggatatagaattattggctgatagttgatttctttcagcactttgaatatatcatgcaattcttttctggcttgtaaagtttctgctgagaagtccactgatagtttgatggagtttctgttgtgactaggggcttttctcttgctgttttagaatgtgcctttcactttggctttagacagtctgattataatgtgccatagcaaagtcctttttgcattgtatttatttggggatcactgagcttcctgtatctggatatctaaatctcctgttatacttgagaagttttcatctattatttcattaaatgggctttctaaaccttttgatccctttttgcccttatgaacaccaataatttgtaaattcagttactttatgttgtgccaaacttctcaaaggctttgttcattccttttcatattttttatatatttttgtctgactggattatttttaaagatttgtcttccagttctcaaattcttttttctacgtagtctagtctattgtggaagcttttgaatacattttctatttccatcaataaattcttcagttccagaatttctgtttcttatttaatatctgtctccttgatttctcattcatattctgaattgttttcctgatttctttacattggtttcagatgtctcttgcatctcaccgagcttccttaaaatcagtattttgaattcttcatctgggattctgataatttcttttttgttaagatctatcttattattaattattaataattaagaattattgtgttcctttaggtttaggtttcctgaatctttacattgatatctccacatctggtgtaaccgttgtttctatttttgaatttactttttttcatggagggtgcttcttcctgaagctgtgtctctggtattgcttgggtggggccctttggctttgcttgtgtgtgtgtgcagtagtgaagtatgacttctttggctataaaccttagtggtatctgcggtttccttgatacattaggtaaagttattagtggagactgtattgaatttatgggggggggactggattggcagatggacctgtcgtcaggctttagtggtagtagtggtgggctaagcattaaagtatgcatgggtttgattagtgctgtgctccacctttgtaggcatcctggcttctctgagtagtatacaaaaagttgagccttaatctttccctgaacactcttgaaattttaagttaattatccacttataagttaaggaaccattatattcattttattttactaggaatctaaaaatgtgttagatttttagaaatctaacacatttttagatatctaaatctaatgagaaaactattttatactaatatcatttttaaacgtttcaagaagaaagaatctatacactttaagaattaaaagcaaatctctttactttttttcctgtctgtctcccactaaaatgttagtcagctcagtgagggcaagccttatctatctagttgacttttgcgagcccagcatatataacagagcctggcccacaaaaaggtttcaataaataattatttttaaaagagagaaagaaatgtaaggctctggggaaagacagatagtatacagataatacttatctgtattcatatgagggagattcactttcccctacttaataatggaaaatgaaagaactttggaaacactatttggaaacgctatttgattgctttttcctatgtgcctccacagcctttgttcataccattacagtgtcatttatcagacattattacagctatttgcatatctatttttcccaatatactctgggtgcccaggacatatcttatttatttttatatacccagggcccaaaatagtaccaaatataggcactaaatatttaaccaaaataggtaaacagtagacattcaataaatgtttgcaaattaataggaaaaaggcataggaaaatagtataaatagtttcttttgtgatcctcttctttctctcctaacaacacccactgttatactgactaatcacttcctttccataatctttctctctcattataaactcttatttctgattagaacaaatgctgagccaggcttattttatattccactattttttcctgttctttttatattcatcaaagcattaatgaaaaaacaagagaatgccttttctattgcaattaaaatctataattccatgtgaaaagtttttagtagttgaaagcaaaagctaaaacctggataactgagaaccttaccctctgtggggatctcatagtactactaagccacctttcaagtaaatttcaaccaagtttgctctacaactctaaatttgactgacaaatctttaagacttgttacacacagatcattagttatctttttccccaacaacaaaactaaataatatttttgcttactatttgtctctagaatttattctgaaagacaactcatgatgctaaaaaaatctcaaagtcaagttatcccagctaccataataatagatcatgtatcactatgctgactacactgtatacatttttctctatcttagaaaaaatattcctaaatgtttatgaatacaaaatatattaattatctgttacaatactctgttctttgcaatatcatgtataagcagcaagtatcatatactacattacatcacttttgcaaaactggttactcacataagccaaacaaagtactaaggctttactatcctaggggatcccaaagggacaggccatgtgtgtttgcataattcaaatgttttctgctttttaaaattaccattcaaatgtttcatttcagagaaaacatctcatcaagtacctatcttaaaaaagtctattgcatttctatacaccaccaccaccagaaatggaattgatctgagtcaagaaacatagccatgcatatatggaactttggcatttgacaaacgtgacataccaaaactgtttttcaaagtagttgtaccaatttacattcccacaagcaatgtttaaaagatcctattgcttcaaagtctttctaacatatggtattgtcagactttttaatttttgccagtttaattgcataaaatgatacctcatttgcatatctatctcactaatgaggacagacatctctttatattcttattgatgtcatgtgtatactcttctgtgaaattcttttcgggccattttccttttgttcattttgcttttctttttgatttgtgaaggttcgctatatgttcttgttacaaatcccttgttggatttataccaatatcttttctcagtgtatctttccattttcttttaaaaattttttgacagaacaaagttcttaattttgaagtagtaagatttgaattagtaaaatttaaactagttaactttgagctagtaaaatgtatgtcttttcatagctttttgtttcatgtttaacaaatcttgctctactcccaaagcgtaaaaaaaaactcttattttttaaagagtatttaaaattgtttttgacatttagatcctaagtctacctggagttgactttttgtctatagttatgagaagccaagtggtagagagactgaacaacaaagaagtcaaaagaatgttgcagctgattagaggaactgggcaaataattttaagccttttctcagcaagttaggaaggtaaaattggagttctgggcctacctaggaagaaatgtctagccaacattccacattttaaatggtactttaccaaactttaaaaattaattctataattttaatacacaatatccagcatccaataaaaaattatccaacataccaaagacaatattggatacttaagaaaccaaaaggaaaaatagacaataggaacaaacctacaagagagccatattacacaaattagatatggatattaagtataaatgagatgatcaagaaaaattatatcatgatgaaaatttcagcaggaaattataatttgtaaaaacatattaagtggaaattcttgaaccaagtaatataataaagattgaaacagttggattcaatgtcacatagacatagctaaacacaggattattaaccataatatgttaatagaaaatgtccagatagaagcatgaagagaaaaacaaatgtacaaaatacagaaaagagcataagagacctatgagacatgatgaaaaaatattaaatgcataatcataatttgaaaagacatgtaagagaagaagaaaagggatatctgaagagaaaatgatcaagaattctccaaaataaatgaaagacatcaaaccatagacttccaagtgctataaacccctagcaggataaataccaagaaaaccacatgaaggcatattataataatattactgacagcaacaggagacaaattcctctgcagacagggatgggtccccagtgaaacccaaccttcaagcaaaggaaagtctaaaacctgaaaatcgaactgccagttcagcattagagtccacgactggagtgagaactttcatccctatcttaccccctctctctcaactggttccttctgaatgatgtcttttaaccaattgaatggtgctttttccaagaccactcaaggacctatcagcatgcagtcccccattctaagcccataaaaaccccagactcagcctcacagccttacccactttcaggacccctctcattgctgagagttttctttctgtcactcaataaaattttactttgtcttactcaatctccaatgtccatgtaccttattcctcttggtctcaggacaagaatttgctgaactgctggagcaaaatagctgtaacattcctcctcaccaagctgggggcagcaggagtaaaattgctgtaacattccctcccactcaccaaacaaagggagagaagaagctgctggacaccactctcttccactcgccgaactatgggagcaaaaaagccacaatatttctaaaaacaaaagattttaaaaatggtttaaacaagtcagagaaaaaaggcacagtaccttcaaggaagttgcaaaatgacttatagttaatttgtcagtagcaacaatggaatccagaggcaaaagaataacctctccaacttgctttaaaaaagaaaaaaagaactgatttccaacttaaaattatttactcagaggaaaaaataaactcaaaacagaaagtggcagtttccactgctagcaataataagatagaatacatatgactaatcctctcacaaataacagacaaaatatataaaccaactactttttttaactttctccttccaacatttattttaggttcgggggtacatgtgcagatttgttacatcagtaaactgcatgtcactgggtttggggtacaaattatttcatcacccaggtagtaagcacagtacctggtaagtagttattcaatcctaacccttctcctaccctccacctttaagtaggccccaatgtctattattcccttctttgtgtccatatgtacccaatgtttagctcccaagtataagtgagaagatgtgatatttggttctctgttcctgtgttcattcactcaggataatggcctccagttgcatccatgttgctgcaaaggacatgacttcattcttttttatggctgcatagtagtctatggtgtatacatggtacattttctttatccaatccaccattgatgggcacctgggttgactccatgtcattgctattgtaaatagtgctgcagtgaacacatgagtgtatgtgtctttttggtagaatgatttattttcttttggatatatatgtaaattgctttaggcagtatggccattttaacaatattgattcttctgatccatgagcatggaatgtttttccatttatttgtgtcatgtctgatttctttcagcagcattttctagttctccttgtaaagacctttcacctccctgattagctgtattcctaggtattttgtactttttgtggctattgtgaatggattgtattcttgatttggctctttgcttggatgttattgctgtatagaaatgctggtgatttttgtatgttgattttgtatcctgaaagtttgctaaagttgtttatcaggtctaggagcctctgggcagagacgatgaggttttctaagtataggcttaaatcgtctgcaaagaaagataggttgaattcctctcttcctacttggatacatttttttttctttctcttgactgattgttctggctaggacttccagtactatgttgaataggagtgatgagggtgggcatccttgtcttgcaccagttctcaaggagaatgcttccagcttttgcctattcatatgctgttgactgtgactttgtcatagatggcttttattattttgaggtatgtacctttgatgcctagtttgttgagggtttttaaactgaaaggatgttgaattttattgaaagccttttctgtatctattgagatgatcgtgtgttgtcttttagttctgtttttgtgattaatcacatttattgacttgtatatgttgaacggaacttgcatcccagggataaggcctatttgattgtcatgaattagctttttgatgtgctgctggattcagtttgcttgtactttattgaggctttttgcatctatgttcatgaggtatattggcctgaagttttcttttatcattgtgtctctgccaggttttggtgtcagagtgttgctgacctcgtagaatcagggaggaatccctcctcctcgattttttgaacagtttcagaatgatgggtaccagctcttctttatatgtctggtagaatttagttgtgaattcatctgttccagggctttttctgattagcagggatttttttattactgattcaatttcagaactcattactgatctgttcagggtttcaatttattcctggttcattcttgggagcttgtatgtttctggaaatttatcagtttcttctaggttttctagtttatgtgcatagaggtgttcataatagtctctgagggttttttatgtttctgtgaggttgatggtaatgtccccatttttatttctgattgtgtttatttggatcatctctatttttttttcataatctaggtagtagtctatcaatcttatttgttctttcaaaaaacaaactttaggtttcattgattttttattttttaaaaaaattatttccatgagttttggaggaacaggtggcatttggttacatgagtaagttctttagtggtgatctgtgatattttggtgcacccatcactcgagcagtatacactgtacccagtttgtagttttttatccctcaccccacctcccaccctttccaatgagtccccataatctattgtatcattcttatgcctttgcatcatcatagctcagctcccacttgtgagtgagaacacacaatgcttggttttccattcctgagttacttcccttagaataatagtctccagctccatccaagttgctgtgaatgtcattaatttgttccttttatgtctgagtagaattttatcatgcatatacacaccaaaatgtgttttacgtctcaattttattcagttcagctctgattttggttatttcttttcttccattaactttgaggttgtttttctcttgcttttctagttcctctagctaaaatttagactgtcaatttgagagccttctgcctttttgatgtgggcatttggtgctataaactttcctcttaacactgctttagctgtgtcccagagattctggtacattgtatctttgttttcatttattccaaagtatttcttgatttctcccttaattttattgtttacccaaaagtcattcaggagcacattgtttaattttcatgtcattgtatggttttgagagaccatcttggtatttatttctatttttattgcactgaggacctggaatgtggttggtatgatttcagtttctttgaatttgttgagaattgctttatagctgagcatttggttgattttagagtatgtgccatgtgcagatgagaagaatgtatattctgtggttgggtggagtcttctgtagatgtgttaggtctattcagtcaagtgttgagtttaggttttgaatatctttgttagttttctgcctccatggtctgtctaattctgtcagtagggtgttgaagtctcccactattatagtgtggttatctatctttataggtctgtaagaacttgttttatcaatctggatgctctagtgttgagtacatacatttttagaatagttaagtcttcttgttgaattgaaccctttaacattatgaaatgcccttctttgtcttttgtcatcattgctggtttgaagtctgacttgtctgaaataaaaaatatcaacctcagctcttttttgttttccatttgcttggtaaatctttctccatccctttattttgaacatatgggtgtcactgtaggtgagatgggtctcttgaagacagcatgcagttggatcttgcttctttatccaacttacttctctatgccttttaagtggggcatttaacccatttacatttatggttaacattgatatgtgcagatttgatcctgccatctatgttgttagctggtgtttatgtagacttgattatgtagttgctttatagtgcattggatctatgtacttaagtgttttgtggtggctggtaatagtcttttgtttccatgtttagcactcccttaacccatttatacctgaggttgcaatttttttaatttttacaatcagaccttggtgatgaccttgagtagtaggatataaataattcccatatgcttattgttccaatgatggaacactaggtgtaaatgggttttaaggacctcttgaaagacaggtctagtggtaacaaattcccttagcatttgcttttctaaaaagggttttatttctcctttgcttatgaagcttagtttgactgaatatgaacttcctggttggaatttcttttcttcaaggattaagcatgctgaatataggcctgtagtctcttccagattctagggtttctgctgaaaggtccactattagcctgatgggattccctttgtagatgacctgccccttctctctagatgcctatagtactatttctttggcatttgccttggagaatgataattatgtgtcttggggatagtcatcttgtatagtatgtcacaggggtctctgaatttcctgtatctgaatgtcaacctctttacagagattggggaaatttttgtggacaatatcctcaaatatgttttccaaggcattctctctttccctctctttcagggatgccaatgagtcatagatttggtctctttacataatcccatatttctcagaggttttctccttttttgtctttttcctttatttttatctgactgagttgtttcaaagaaccatccttcaagctctgagattccttcctcagcttgatctattctgcttttaatacttccagttatattacaaaattcttttggtgagtctttcagctctatcagatcagtttggttctttcttaaaatggctattttatctttcagctcttgaatcatttgactggattccttagattccttggattgggtttcaactttctcccaaatcttgataatctttcttgccatccaaattctgaattctatgctgtctttcagccatttcagttgggttaaaaaccactgctggtgagctagtgcagtcatttggaagtaagaatacattgacttttagagtggccagagttcttacactggttctttctcatctgtgtgggttgatgttcccttaaatctttgagcttgttctcctttggatcgagctttttgcttttatattctttgatgcccttggtggtttgactgtggtataagttggatttggtcaactggcttcatttctggatgatttcagaaggtcaaggctcagctcatcacttctgtgctgcatgctctaaccctgtgggggctgggaccaagcccacagctttgttctctggccctgctacactggagagaccaagattttcctggtccactggcaacaatactctgatggagggtgctgacaaaagcccttcatcagggtggtgtcagtggggttcatgctcacatgtgtgcacctgcagcaacagggcagtggtagggcggtgggggctgtgcatgcacatgtgctccagtggcaccagggtggcagtggcaaggtttataggaagaggctgcaggtgaatgcacaccagcaaagtggtgggtggaagctgtgagagggtgcacactggtgagggcccatctgcaaaagttatctgacagttatattggatctaccagccaaagagttatggtggtggctacaggaaagtatatcagctgggcgtctgaggctgtactgcaagtggatgcagccagacagagaccttgggagaggctgggcagacagaggagcactcatcagactggctccaccctacagttagatagccctgttctgtctagatctgacagttaagaaaggccaaaaccacctagaggagtatggcaagccttgggggctgggcatccctggccatgtgccactgtgatcattcttgttccaaaccttctgggttccatgcaggctggattcctgtctttgccagctctccaaacagctctccttgtcagttcaaatgtctatggggatcatggggtctcctgcacctaggattcttgaggtccctggtgagagcaggccactctatgcctatttaactcatcccttccctgggagcctctcagggccaggaatgagtcctggtgcttggcaaccccatgcagggttcccaacttcctccccccttcagcccaggatctgcattctccttccaaccactttcaatgccttccttccgaagtactgttcagaatgtgctgattttgacggtgtggtctcttggtgggagaagctcttcctgaaccctgtagtcagctatcttggctcctcccaaaacaactatttcaaggcacctgacaaggacagaaagaaaaaagaaactggagagaatttgactcttgaaatactagaaaccgtagtggttgagagttacatttatatggcatttcctgtaagtacactctccactgggacagcatagggcagttagaactcaagtagaaagctaccatcttactgatttaagatgtcacaggacagagtctgggaaaggacagaatgagcaaaaactgaaggtaaaaaaatctcataaaagagaaaactacagactggggagccctaaaggtacacatgaatttttctaaaattggggagatgctgaagaacccaatagaaaccaatactcataaggaaaaaaaataaaaataaaaatctgtgctgtgatttcaattgctgcccatttcatttcaggaacaacagagtttaaagtttgaatcctgcaagttagatgggttttgtaaacacatcaaactgtccactgaaactccaccaaggccacactatagaataaaagactatgtcccaggactaagaattctctgtaagaataaaaaccgaatcaacctgttaaaaaggctacacaaactcctggttattcatcagtaatttaaccacctgctgaagtaaaactcaacactcttccaaggaaaataaaagaatccgaaacatctctttctttttccatctctaccatttcacccaaacaagaatccaaaatacttatagtctattttctatgctgtcaagtatataaccaaaacttactatcatatgaagaaacaggaaaatgtcacccatagtaaaagaaaaatcagtcaacagaaacaaaacccagttgtagtcagcaaataaagggtgtaatgcaactatcataaatagattttaaaagaggctagtcctaatggatgaatagataggacatttcaggaatggaaactattttcaaaaaacaaatgaaaattcaggaactaaagtaaaaaaaaagttcactggatggattttaaaatagactggagagggcagaaagaattattgtgatatatttaaattaaatgttataaagtaccatttaaaatatcagaagatatgaaatacttggggacaaatttaataaaatatgtgcaagatttgtatccacaataaatgtagagatatataccatgtttttaatcagaagactcatcactgttaaaatgtcagttcagcacaaattgatccatagatctaatctagtcctaaccaaaatctcagtggacttttttgtaaaaattaacaagctaattctaaaatttctatgaggttcaaggcacctagaataacctaataaaaataatttgtatttcaattactatgaggtacagtaattaggactattgtggcattggtgtaagaatagatatataaatcaaagattcatattcatgtaagagcacctaagtagacccatacatatatggtcaactggttttcaacaaaggtgaaagagtaattcaaaagaaaaaaacagtttattcaataagtggtactggaaaaactaaacatctaaatgcttataaatggtactggagcaattaaatttctgtatttcaaaaaaaatatgacctctaattcacacaattcataaaaatttattcccaggtagattataaaacaataaagcttccagatagtaacgtaagaaaatatcttcttgactttgaagtagttatgttaacaaagtttttttttaacagaacataaaagtctctacccataaaggaacaaaataataatttggaatttatttaaattaagaacttctgaatattaaaaaatggttaatattatgaaagggagaagatatttgtaatacctacaactaacaaaaggactcatatctagaacatataaaaagttatcacagaaatacaaattaaaactacaatataataccactacatacatttgaattaaaaacactgacacttgccaacaccaagttcaccaagttcacaagaatgtggagcagttggagctcgtattagaaaattcactttggaaagctgtttggtaatatctactaaagctgggcatatgtataccttatgacccagaaatttcattcctaggtattagtccaaaagaaagtctacattaatgcactgaaagtaatacacaaatgtgtatataatagcaatgctcattaaagaaaaaaccagaaataattcaaatgttcatcagcaatagaacagatagataaattatggtttattatcaatgaatgaatgaactactacatggtgagctctcacagacatacaacattaagcaaaagaaatcagacacaaaatacaacatactgtatagtctcagtatttgaagttcaaaaagaggcaaaactcacctatggtgttagaagtcaggatagtgacagagtagtagctggtagcggggacaaggggccctcttagggttctaataatattctatttcttgacgtgggtggaggttacatgagtgtgttcactatgtggatatgtattgttgttagagataatgtgtgcacttttctgtatatatgttattcttcaataaaccatttaaaacattaaaaataaccacttgtgtggcttagaacagttgtccccaaccattttggcaccagaaaccggtttcatggaatataatttttccacagatggtggatggggggaatggggatggtttcaggatgaaaccattccacttcaaatcatcaggcgttagagtctcataaagagcacacaaactaggtccttcacatgcgctgttcacaatagggctcacactcctatgagaatctaatgccgcagctgatctgtcaggaggtggagcttaggcagtaatgctcacttgcctgccactcacctcctgctgtacggcctggttcccaataggccatggaccagtaccggtccacgacccagggttggggacccctggcttagaagcaatgtctagagattttagggtaatagaaactatataaaggtagtatatatgctacaggcaaaacatgtaatctagacattataaacaactcttacctaattcctgggtaactgctatacgaatattctaaaactatttaaagaaaatgtcaaatttaatactttgtcattgtattggtagtgtaggagtaagccataagatcatgagtaactataagtattacttacaatgtgaaccacctctgctgaatctctacacttctacccacatactacacatactacctttcctttcaccgtctctcctttatactacccctgtttcacctttcatgggcaggttctttaggtaaccaaaatacccacattatttatcacttcaagtctgtaaataaagccacggatagcaataaaacagaatcttgtagtaaggctacataaattatagtatgtctttattggaaggaaaagttttctaaattggtctcaaaattcttaaaaataagtcaataaatatataataaagctatctgtactctcaatatattttcacttttccaaatactttaaccttattagttgttcttcattagtccttcaccttatgccactggacaaatacctttaaaaaaaaaaaaactcaaagcaggaaactacttaaaatatgtttcaagtattttgtagagtttattggatcagaatccattcttcttatacttcaaccccaccactgagcttaaaattccttccaagcttttgggaacagtgctttcactgtcactatccctactatccataggataatcattggctgttccccaaattccagaacgatgtgccattgcattgctttcctcccacactgaagttgctggcggtagctcattttggcagtttgtcaaataaatcacacagtaaagcatttggtgatctttaaccaaatgaatctgttgtgtatacagcatatgacatgtagaggtatttcacacattataatagaacacagtgaaggatataccctgtacagcataatcctagaatcaagacttctctttgagaacttctctttaaaataacatcttttttttgaactaaaaagattaacttacttaaaaacaaagggaaataccatctcatggcaattattgttcccttctgagaatgactgatgacgtacatacttattaccagacagtttatggaaactatgttgtcaaatagatcacattttcctacagaaacaatgtcaggatagggctcatatcccttaccaaagaatcaacagagaaactataattatgagagttaattttccgtaaaagcaaagataagactattacaaaattttataatataaagtgacaaaaggatgcttcaactttttaatttatttaacaaacgtttaacaggtgtctgtgatgtgtcaggcattggtaatcaaataacacttggtacctgccacgctcaataaattaactaacagtcatgatttactaaacaagtacatcaatgtttactgtatggggtggttagtgtcatgaacgagaggtgctcagtctgtaaggacacagaagacagtcatctaaatcagcatacggggtcagtaaacacttcctggaaaagatgacctgggctcagctttgctacatgagcaaaaactggctgaattagaaaagcaatccaagtgacgggaataaggtcatgttttgcataacaacattttggtcaacaacagatgcgtacatgacggtggtcccataggaatatagtagagtcgaaaaactcctattgcctagtgacctcatagccatagtaacattgtagtgcaacgcctgtgggttttggtaacacttccagaagaaggcattgttatcacaggagatgaaaattcccatgcgtgttattgcccctgaagacctttcagtgggacaagatatgaaagtggaaggcagtgatattgatagccctgattctgtgtaggcctaggctaatgtgtgtatttgtgtcttagattttagtaaaaaaaactttaaaccgtaaaaaaaaaaataattaaaaatgtaaaaaagaaaaaaacttatagaataaggacataaaaaagaaaatattgtgcagctgtacaatgtgttttaatctaagtattactacaaaagagtcaaaaagttaaaaattttttaagtttataaagttaaaaagttgcagtaagctacggttaacttattattgaagaaggaaaaatatttttaaataaatttagggtagcctaagtgtacagtatttataaagtctacagtgatatacagtaatgtcctaggcattcatgattccctgactcactgagagcaacttccagtcctgcaagttccattcatggtatgtgccctacataggtgtaccattttttaattttttataccatatttttactgtgtcttttctatgtttagatatacaaatacttaccgctatgttatattaataattgctggcagcattcagtatagtaacatgctgtacgagtttgtagcctaggatgcctaggtgtgttgtagactatgccatctaagtttgtgtaagtacactctatgatgttcacacaatgacaaaatggcatatggatgcacttctcagaacatgtccccattgttaagtaaggtatgactgtagctgataacacatgcacagaggcataaagcaacacggaacattcaagaaactgcgagttcctgtttggaggaacatatgagggaggtgcatcacaggaaagaggtgcaagataatggtagaagccaaatcatgaaatgctttgggaggtaggtttaaaagtttgaactttattgaaaaagatagtccccctgatcctccaacagctactaaaaatgattttaagcagagaagtaaaatgagcatattttcatttttaaaagatctatttgattttactatggaggaaggctaatgcaataatcctgaattcatgaagcaatgttaggaatagagtagaaggaacagatctgagagacaacaaggagaaaaaattcattgaacctgactgataaaagaatctgtacaccaaacccccatgacgccaatatgacaaacctgcatatgtaccctgaacctaaaataaaagttttagaaaagtttttaaaagttcattgaacttagacattaattggaagagagggtggaatgaaaggaagagtctaaactggcttggtgactaagatgatgatcaagaacaaggacaaagagagggtctcagttggtagggagcagggaaaaacaacaaatatatttcaaattattttgcacattatgttttctatttattgtctgaagaatacctataaaatataaattgtatataacatacataacaaagtgtagccattttggaaaacagtatggaggttcctaaagaaattagaaatagaactaccattaagagccagcaatccctcttctgggtataacactgaagtaaaggaaatcaccacttcataaagatgcctgcactcccatattcactgtatcattattcacaatagtcaagatatgaaaacaacctaagcatccatcaacagatgaatcgataaagaaattggtctatatatacaaaggaaaaaaggagaacctgtcatttgccacaacatggatgaaagtgaagaacatcatgctaagtggaataagctagacatagaaagaaaactattgcaggatctcacttatatgtagaatctttgtttaagaaagtcatacagagacagagaataaaacagtatctaccaggggctgggggcaggagtgaggaaatgggtcagtgcaaatcaaaggatacaaagttgcagttatgaagaatgagctctagaaatctagtacacaacatgaagactatagttaataatgctgtattcaggatttttactaaaggagtagatttagatgctcttgctacacacacaaaaaaatgggtaactgtgagattatgaatatgtcaatttactttattacagcaaccattttactatttatatgtatttcataacatcatgttgtataccttaaatatacacagtaaaatttattttaaaaataaattcacataaatacaaaaatttttttttttgagacgaagtctcgctcttgtcccccaggctggagtacaatggtgtgatctcggctcactgcaacctctgcctcccaggttcaagcgattctcctgcttcagcctcccaagtttacaggcgcctgccaccacacccagctaatttttgtgtttttagtagagatggggtttcaccatgttggccaggctggtcttgaactcctgacctcaggcaatccacctgccttggcctcccaaagtgctgggattacaggcatgggccaccgcactcggccaaaaattttttttaaatcccctgtatcatacatgtgacataaagcttattgttactagtatattcattttaattatttaattagcaaaggcttcctgattttcttaaagttacgttgggggattgagggagaaaaatatttaaaaatcccaagtctcttttacaaagctgaacaagaaaatttaactttccttttcctcccaaaatagatacttgcagaaagctgatatatacgaaatcattccactaaccaaagaatattcagcaattattttaaactgtcctacagttgagacctatattcattagaaaattgctgtattatcataagtaaagatctcaaaaagatgaaatatatgcttttattatgtaatattaacaaagcagcaacttggctcattcacagtttatgcaaagcattttttgaaaagtttaggaagtctaaacctccagaaatttgcaaggttaaaaatgtacttctgagatggtcaggtctgaaacttctatttcccagctgttttcaaggaacttcataatttatttatgtatagacaaataaatcttcagcttcattagtcatttctcactatattctaagaccaaaaaagggtactcttctctttgtttattatggaaaagctatggcaaggcaggggaggaagaggaattgcctggggggaccgagcaactaaaaagaagagcctggagtgggactgagccttggagctgtctaatgagccactctgcctcccacagctagctcctcacagctctgcaaaagactaaaaaactggagccaacaaaaacaaaacactcacaaatctaatttgggtgactaacaccctaaagatatgcagtttgctcctgaccaggattggagtactcactttctttgcgaacttcctcaagtgaagccgtaagctcatcctttaaaactgtagcttcctgggcaatcttctctcccttgtctaataaattccaagttgcttcctccacagaagctagaaggacactggctcttttcgaacgtccttttttcctgctggaagggttctggggacagtttacaagtgtggtaacctaaaattggaaaaatacaaagtactaaattgacaaattgtaaggagaacacagtcctgggatattacagaccagaacaaaagacagtacagttgacacttgagcaactcaagggctaggggcgccaacccaccgtgcagttgaaaatctgagtataactttcaactcctcaaaaacataactacgaatagcctactgttgaccagaagcctgataacataaatagtcaattaacacagattttgtatctgtatgtactatataactatattcctacaataagatgagctagagagacgatagtgttatttgttattaagaaaatcataaggcagagaaaacataattaaataaatcaacaagtagaaatggatcatcataaaggtcttcatcctcatcatattcatattcctgaggaagatgaagaagaagaggagggttggtcttgctgccttgggggtgtaagaggcagaagagatggaggaggtggaagggaaggcaggagaggcaggcacacttgatgtaacttttattgaaaaaaaatctgattaaaagtgaacctgcatagttcaaaccagtgttgttcaaaggtcaactgtatttcatagtaacatgactcatttccagtgctgttggtacacctacaaaagtcaagtcatggcaccaagaacagcaacagcagccaccgtggagttcccaactaaaaataggaaggaagtgggagtcttagtgattgaatttcaaaatatagacattaaaatgtcctctcttcaactaccccagtcatcaaatcatttctatgttaaatatttactgaacacctattttttacattgttctggatgatggaaaagaaatgcatttcatgctttcatggagtttacattcttaatatcggcagcatacaataaacatataaacaaatttaaaaatgtaaggttcagtaaatgttttgaggaaaaataaagttggcggagggaatacagtgagagagagtggggatcggggtggtcaggaaaggcctcttgacaggggactttgagtgagacctgtttgagaggccaaatgagttaggggaaagggtagaagacagatctgaaaggttacaaagggcaagaaagtaggtcatagtaaggatttggactttgtcccctgaagcaaccactgttctatatgattcagaatgtttctccctctcctaatattagttatctctattctcagcctaaatagactaatactgacttaattataattatttttggctccctcttaatgtagattgctggcttaaaagtggtataaattttattttataattatttgatattttggagatacataattttctactctcatttttgactgttttatcaaagttctgtattttttatatgaagtttctgtaattaaaacaatacacacatacacagccttctagagcattcttcgagtagcaaaacttgaacaaactcctcaccacaagtatatgaagtgagaaatgtgttaattagcttgatttaatcattttacaatgtatacatatatcaaaacatcacagggtacaccataaatatatataaattttattcgccaattttaatttaataaagcttggggaaaaaaagaaagaaatgaatcttaacaaatacaagaacaaactcataataagaacattatttgaagataaaaattaagcttctgtatttggaaacaaaaacatcatactgaattacattattaaaaaacacccatttctggccaggggcagtggctcatacccataatcctagcactctgggaggccgaggcgggtggatcacctgaggtcgggagttcaagaccaacctgaccaacatggacaaaccccctctctactaaaaatacaaaattagccgggcatggtggcgcatgcctataatcccagctactcaggaggctgaggcaggagaatcgcttgaacccggcaggcagaggttgcggtgagccgaaatcacgccattgcactccagcctgggcaacaagggcaaaactctatctcaaaaaaaaaaaaaaaaaaaacaacccatttcttaattaaatcttggatcacaattacaagttttggattaaatttttataaacaaagctttaaaatcaccatcgtagaggaatgagagaaaggaaaaaaacaacttgtatctaatatttaaaatagaagacctgaaactcctcttgaaagctaatctgctgcatgtcatgaaacagtggaggctcatgataatcatgcatcacatctttgacagcaaactacataatgcttcctgctcagtagtccctagagattttcgttgttgtttgtttatggagcattcgatgtttgtttacttggatatctggacccagtttttatccatgaactaaaaaaaaaacttaagaagttatgggggaaatatgcggatgaaaatcattttcatctgccctcctaccctcctccccttacccaatagatcctctgtttcattctaatttgctttatttccatgttcatcacccagagtggaatgtcttgtggcaggcctttgtttcctctcttagaaaataaaaacaatcattgttatcctacaagactggggaaggtcaaataaggtaaagtattttggaaaatgcataatatgacacaaatatttgttggcatttcatgtatattttctagtttgttccccatgtaggtgcagaaaattggttataggaatctttaacaaaggtattctctctggatctaagtttatcttgctcttggggccccccatgctaaatgtggcagttagcaaagctcattctatatgctttacaagcagctaaataagatcatgtgtcttcatcatggattatataagaataataataagcctgatttattacatgggttttcacaaattccaaaaggcaaatatctcactcttgtcagtctaatttatatattgagagttgaaaggtatttgtccagattaagacaaattataactaccagtttaaaatctttgtttaaaacaaagaataagtatcattgtctgaagtgttccctcggaatgtattttaagtgctgcaattcatgatgcttcccactgcacattcctcctctattgttcagatcctccatgcgccaaatgttttccatagaatagcctgggctttgaaattaaaatgagcgttccagaaatgctttgttccttataataaatgccagagaagtaagaaatgtgaaaagaactttgtataagaacatcatgcttccatcaaaaaaggcaattgcaacttgcaagttattcacttttataagttgtttgtacctacgtcttcttttaaaatactccaatacagttatttgatattgattaaactaaagtcaagtgaggttttcaatgattccttttatttcagaaagtaaatatggcttggcaatcctgtggaaaaaaagaaagctgaaactattttttttaaccctaactcacctaagagatttaacttactcctatcagtgactgtgactcaccatagcagatgattctcaccaaggcggaggataggagggcgctatttgaaaaggtctcccacctcttgaaggaataccagcaaccagtaaaattagctttcaagttatcctgtaaaataaatcctgtgtcctcattttctttttcagtactaaatcagttatatttctgtaaggaagtttagttggaacaacttgcaacaaagatgattctaatgtagggtttaagcccatgtcttgctaactttaccttttgccatagatacaaaaccctcccattcccctctttctcagacttcaggggtccctctcatatagaaaatctccaagcttgcagcattagagagcttgggtttgcttactttctttagtctgtaaatctgtgctaggctataaagacacaccttcatcgtagatacaggaaggaacttccatgggaatggtgctaaattaaaagtttcaagtaatttataaagaagaaattcccactctattaattctgcaagtttaacattccacaaaaccggacatattttcaatggtgtgtaaaaatatttatatattaaaattaagagtataaaaaaggtttttatagattttccaaatttaggtgtgcttctctaaatgctctaaagatgctgaaaattaaattgataagcttaatgaaccaagccatcaactgtcattatatagagccacactggcacacaatatgaacactgtagaatatgttgacttttttttttttttgagacggagtctcactctgtcgcccaggctggagtgccgtggcacgatctccgttcactgcaagctccgcctcccaggttcacaccattcgcctgcctcagcctcccaagtagctgggactacaggcacctgccaccacgcctggctaattttttttgtattttttagtagagacagggtttcaccatgttagccaggatggtctcgatctcctgacctcatgatccgcccgcctcagcctcccaaagtgctgggattacaggcgtgagccactgcgcctggccgtgaaatgtcttttttaatgccaacttgggtaacacaattatattctataaccttgttccttcccaatatagttctgattttttttaattctaccctcattgtagtataaaaaggccctgttaacagccatctcttttcttgtttattagctaaaacactttgaatttcaaccttcctccaatagctcacaggagccttcagggctacttttgctcccttgagttaattttaatgtatgaaataaaatataagacatttaagctatgttaattagctaaaacttcaacagggttctgaaagaaattagaagggtagaaaaataaaactgcctatagataagtaaaaactgtgatctttcaaagtaaaaggtacaaaccagtctcggggaggagagggggtgtcccttcttcaagtcattgataatttcaactattcttttacttctaccaaaacaacccttactggattaacaaaagtacagaggaagattaaagggttgagaacccaaaaaatgcctctagataacattcaacacccccccaaaccaacttcaatcttcttttagttcctttcaagccaataaacacttatattttgttcaaaataataccctaggcattcaggaaataaatatgaataagctccaatatggcaataagagaaatacacaactagttgcaacattaaaggcagaatgataactgtttacacttatataagtacaaagaaagtgctgccaaaattgcaaacattcacaaggattaagtaggacttccaagaagagcctttaagaacagataattttctaccagaagagataaaagggaggtatgtaagccagggaaagaaaattgtgtgcaaaggggcagagaaaaaaatttattttgtctgaaaatagcagatagccaaacttagcaaactgtggggtaaacacaggcaatagggtgagaaggccaagaaataggtttcatcttaaataaaaagttataaaagtcaaagaaagagttaatatttaatgtaataggtgatagaaaatgaaaacacagcatgcccaaagtagagaagcctttgcccatcaacctgcctctccaccatctgtattttttacctcagtggctaacacctctaacctgaagcagaaacccagaggtcatctgggctagtctctctctcatcttcctctccaagtccttgtcatccaagacacagaaacggggcatcattctctgccccattcaccaatctatcattatgaaaagtgtgtgcaatgattctgccctcgttgaatctttcatgaagcgtcttctgagaggtctcactgcctctgcaccagccctacattcccactagagccgtctcttgaaaatgtaaatctctcatatttgcactacctgtaggctacctgctgcctacaagcaaagtccaaactctttagcgtagcttttgaggcaattttgatctcactgctcactaaattttcattctcatcttctatctgtggaatctgaccacaaactacttgttaggctcagaacaggaaatgttcagcaacctcaacctggggtgactccctcccctcacagctccttgttcgtagctcttgtatcactcattatactgtcttgtaattagctgttcacatattgcctcctctgctctaccacgaactcaataaggacaggggccgtgcttgactcatcctgaaaacacagagccagcgtactgtgaaaaataaacaaacagtggtttactggatgaaaaaaaaaaaagaataaaaccctacattttagaagcctttaaatcaagagtcacaatgttcagtgattcatacgaggttaccaaaagaatgggttgctacagcaaaattaaagtttagtgataacacatagcagctttcattaaaaggaagtccttaatgtgggattttctgccatatctcctgtctagtttagttggggtctgatcagttcaatgtaatctaggatcaagtatattatatccagtctttttttgccccccccaacaaagacacgttacataattcattttcaaactacaaataaaaagagctggcacatcctttttattactgattttttcatttttttcaatccttgtgttagttttctagggctgccataacaaaataccacagactgggtggcttaagccacggttccccaacctttttggtaccagagacccattttatggaagacaacttttccacagacccaggggtggagtgggggtagacgtttttgtgcccggagttggttccttctggtgggttcgtggtctcgctgacttcaagaatggagccacagacctttgcagtgagtgttgcagctcttaaagatggcatggacccaaagagtgagcagtagcaagatttattttgaagcgtgaaagaacaacacttccacagcaaggaagcggaccctaccaggttgccactgctggctggagtggccagcttttattcccttatttgtccccgcccatgtcctgctgattggtccattttacagagtgctgattggtccattttacagagcgctgattggtgcattttacaaacctctagctagctgcagagcactgattggtgcattttacaatcccttcgtaagacaaaaaagttctccaagtcccctacttgacccaggaagtccagctggcttcacctctcagtttcaggatgattcaagtggattacatttattgtgtactttatattattattacattgtaatatatatgaaataactatacaactcaccataatgtagaatcagtgggagccttgagcttgttttcccacaactagacggtcccatctgggggtgatgggagacagtggcagatcatcaggcattagattctcataaggagtaggcaacctacgtcacaataaggttcactttcccatgagaatctaatgccactgctgatctgacaggaggcagagctcaggcagtaatgcaagcgatgggggttggctgtaaatacagatgaagtttcttttgctcacccacccactgctcatctcctgctgtgtggcccagttcctaacaggccatggacatgcaccagttggggtactcaactggtactggcactggaggcctaggggttggggacccctgggttaaacaacagaaatttattttcttacagttctggaggtcagaagtccaagaccaaggtgtcaacaggtttggtttctcctgaggccttgctccttggctatcagatggctgtcctctctctgtgtcctcacatgtatgcacacaacaatgatgtctttccctgtacatcctaatctcttctgataaggacaccagtcatattggattagggcccacccaaatgaccccattttaatttaattacttctatatccaaaggccctgtctccaactacggtcacattctgagaaactggggttagggcttcaatatgtgaatgttggggttggaaatggcacaattcaatccataacaatctttaccacaagtgatacaaaaagtgtaaaataaccataacctttttaaaaatataatttagggttttgtttgtttgttagataaacaaccactgctaacataagccattactccgaactattgagggacagtaacaaagcacatgtagatccctctccaattccaccagccctctgtgccacacagatggcataacaaagcaaagagatttacgtgtcaaacacataagcagttgtagctaaatatcctaatccaagaagtgcacttactcctggataaatataaagctaaacacaactaggaaaagaccacatgctgagaataataccaaattagtttcttctagttttcacttaaccacttaccatccaaaaacaaacgagtttggactttaccattcatttattcaacaaatattgatggtgcacctacactgtgccagaacatggcaatgagcctcattctaagaaggtgggggaacagagaataaacaaatacataagtaaatgtgtaacacaacggcaggtattctttttttttttttttttttttttgagacagagcctcactccatcacccaggctagagtgcagtggtgctatcttggctcactgcaacctctgcctcctgggttcaagcgattctcgtgcctcagcctcccaagtagctggcattacaggtgcctgtcaccacgcccagctaatttttgtgtttttagtagagatggggtttcacccatgttggccaggctggtctcaaactcctgacctcaagtgatccacctgcctcggcctctcaaaatgctcagattacaggcgtgagccactgcacctggccaatagtaggtattgacagatgctatgaggaaagtgaaaaagggtaagaaaataaagagtgaaagagaagagctagtttagactgcatattagggaaagcatctctgattaagtaagaaggatccaaggaaacagaagaataagacatttaaatatctggaggaaaacatcccaaacagaagaaacaggcgcaaaggttccaaaacaagagcttgactgttgtattccaggagcaataggaaggctggtatggaggcaccaaattgtgcaggacttgtagatcaccactaatgctctcaattctattcttatgactggaagttactgaagtgcttgaaacaggaaagtaacatgatctgaccccaaattttaaagcatcattctaaatgctctaggcaaaacagactagagacagctctatgcaaaacagactaggcaaggatgggatgaggaatagaagaagggaaagcagttaggagtccgttgctgtagcccaagtgaagaccacactggcttctttgaggaagcagtggcggagttaagaaatgacaaaattttggtatattctaaagtgtcaacaaggtttgctgacagattgaatatgggttatgaaagcaatatggcatcaaggatgactctggcatctggcctgagcagctgagtaaatggaggtaatatttactagttgaggaaagtaaagggacatgagtaggaagggaaatcaagagttgatggattaccatggcattagccatgttaaatttgccttttagagtttttaaagtggagactagtatacaattctggaattgaaagaggtaaaagttggagatatgtttcgtataggttactttttcaatttaattgttcacttgtcagtagttttgctgatcttaccaaaattgcaaagacgtttggggaaaaatttttttttaatcagagattgaatgagatctcttaaaaacgatgtataactggagaagaagtcacaggactgagctttgagaaaccccaacaattaggtgtagtatttctcaggaaacccaaccgttaacatattaattctaggatatgtagattttgtcatttcgaacattactattatttagaggaaatgcctggtttttgaaactaaatttaatagttgttttttaacttttattttaagttcagaagtacatgtgtaggtttgctaaataggtaaactcacgtcatgaaaagttgttgtacagattatttcatcacccaggtatgaagcctagcactcaatagttatttttcatgattctctccctccaccctcttataggacccagtgtctgttgttcccctctatgtgtccatgtgttctcatcatttagcttctacttataagtgagcacacaagtggtatttggttttctgttcctgcattagtttgctaaagataatggcctccagctccttccatgttcctgcaaaggacatgatctcatttttttttaatgacagcatagttttccatggtgtatatatgccacattttctttatcctgtctaccactgatgtatatttaggttgattccatgactttgctattgtgaattgtgctgcaatgaacaggcacgtgcatatgtctttatggtagaatgatttatattactctgggtatatatccagtaatgggattactgggtcaaatggtagttgtttttaggtctttgaggaactgccgcactgttttccacaatggttgaactaacttacattcccaccaacagcgtataagcattcctttttctctgcgacctctccagcatctgctttttttttttttttactttttaataatagctattctaactggtttgaaatgttatctcattgtggttttgatttgcatttctctaatgatcagtgatgttgagctttttctcatatgcttgttggaaaaatgcctgttttatacagaacaaaaattcagacaaattcagttttaaaaatgtaatgttaatcatatagtctccttttctacaaataaatatttcaaaaaatgagaagaaaaactataaagatattaaattaagcaaactaaagagaaattatattcatgctgtaatttattcctaaatcaaacaactagtaattccagtaaatcaataatccatagtttataggacagtactgattcaaagaaatgttgaataagaaaaagcaaaaagtcaacctttttccatcaataacctttgactgcttaaaggaagcaaaacaaaaagtaaaaaatccaatcataccaaagaagactctaaaataaataagttgactgcacatgtaatagcttagatatgttcacataatcccttggtccgtccagccccgcattccacttccagcagtgactgatggtagaatatggttatgactcctacttacgtattccagaattgtttgataatcatttacaaccctatcaaccataaattgaataaactatgccaatattttgtcatttgtgtttgctttaccaacataaacttagaaagttttatctgcatttccctcccactatctgctgccggattccctttttcacatctaccttagatggtcagatttactctttcttgttctcttctaacacaaaactccattttattgacgatatccaggagaaaatatacatagctacttgctcatcatgatgaatatgagagataataaacattaagcaaaaaagatcatcaaagatagtgattagatttgcagggctgaagattttatagcaaccaaaatatgatttaaatatagctcatcagcaaattaaatacttatattcagtttaagattgattaggctgtatccacctcatttgtcagaactctctctaagtcaatagtcattttgtctcattgtttggggtaaaaattaaataccagtcacccatcttgaatctcattggccagcacttgatctttaatgtcccaaagtcccttctttgatattaccatagtctctcaattctaaaatactatcaactacaacacaaaccaccaatgtaatcacttctcttaaaagtgtaaatatggatattttgtcaatattgaaccttccataaccaaggtgaagccaagagacttattgtctaggaataaagacagcagacagaacaaagataccattgatcatctttgagtttcaaagctgactttcttaagctctcaagaaagaaaataattgtgaagctggaggcatcatactacatgacttcaaaatttactataaagctatattaaccaaaacagcatggcactggcataaaaacagacatgtaaagcaatggaatagaatagagaacccaataccaaatccatacatttacagccaactgatttttgacaaaggcaccaagaacactcactggagaaaggacaatttcttcaataaatggtgctaggaaaactggatatccatacacagaagagtgaaatgagacccctatctctcaccatattcaaaaatcaactcaaatggactaaagatttaaatgtaagaccaaaaattatgaaactagtagaagaaaacacagaaagagaaaatcattttctaaatccttttggctctcatttagcaaaagctagatctgatagactagatcacagttttatgataaagaagatctggtcagacaggaaaaagaagtgtggactattggaagaaaggtctcagaaacaggttagacacattttatttctcttctctgggcttcacccagattaaaagctgtaatggctctcaactaacacagttagttgggaaacacagaaagccgaggaatttttattccatttatcttcaagactttgaaagaaaattgttttatgagctcccctgcacaaaacttcaggggtagctacagtgtaatcttgccatcacaatcttgaagctcaataatacataacaatgtaaatgggtagagagaaggtcagcttagctttcttaaatcagtcttgattcccatgaggcttagatgaaacccagaacatcctagataccatgaaaaacaatcaaaatgaggctatgttgaaaagcagtgggcctgccctgagttcaccatggtgaagagccaagtgatctagcagagtctgagggtacacagataatgccagatactggatggaggatgtagctgggacttcgaatctgaagcaccatcaagggccaaagtggggttaaagcatcctggagaaaccacagaccctagccaagctacaaaagaacgccccacaaagcatataaggacatcaagaaatgcacagaggtgcccacaagatgaccatgcatgggacccatcactccctcaaaggtcacagtccagagagcattccagaccagccactcggcaggcactaagtgtccaaaggtcaccacatgggtccaaaggccgcatctcccaccgtgaaatcatataagcaacaccctcaacccaatctcctgttttagagcattttatctaaaaagactgagcatttaccaaaagggactgtttatattgttgaatcacatcagtttaccatcttattggcttaaacagaaggcatttattccaattcccagtaggtaggagtttatgaggaaggtcagatcacttacgaaagataaactaaagtgtgctgtgggaaaacttgtaatcccctacaagtacaaaaaggaaagctacattaaatgtttatttccattatacgatgcatcctaatttcagaaatggtaaaaaatgtgaggtggacaatgtgggaaaatgtgtttaaattaacgaaatatggtatcttgcaaatcaagattgcgaatgcaaactgtttcctaaaagaaaaaactcatctgaaaaaccacatttattaagccttaatttatttaatttgtagagctttcactactgtacatatatatgtgtatatatatgtatatgtgtgtgtgtgtgtgtgtgtatatatatatatatatatatatatatacagaaatgtggatatctatgtattcaaattcagctacaatgaggttaaaaaggcatagaaggggcaccattttatggcaagctttggaccaagaggcagaaccatgctcactactggctgatatcatggccagcataacagttctgacatggtaatcacctgggagctttaaaaattattgtctagtcctacttccagagattctgatttaactggttttgtgtaaggcctgggcatcaggacttttaagagctccccaggcaattttattgtgcagccagggttgaaaaccactgggctaacagaatctcaacaataacagggattttctgaattgcctacttagtactcttcctccaagtaagccttctgtatctcccatagggcttggccacaaaccactccatcatactttatctcactgggggctctcaattgtgtgtgagataatgcccatttcttacccttccttaaccagggagtgcagagtagctccatgagaaaatggtcagtctaggccaggcgcagtggctcacgcctgtaatcccagcactttgggaggctgaggcagacggatcacgaggtcaggagttcaaaacctgcctgatcaacatggtgaaaccctgtctctactaaaaatacaaaaaattagctgggcatgatggtgcacgcctgtagtcccagctactcaggaggctgaggcagaagaattgcttgaaactgggaggcagagattgcagtgagccaagatcgagccactgcactccagcctaggcaacacagctagacatcatctcaaaaaaaaaaaaaagaaaagaaaagaaaacggtcagtctagaaccagggccttccaagacatagaaggggcaccattttacatcgtaggagccaaatctggcctcttgtctattttggtaaataacaaaattttactggaacacagccacacccatgtgtttacatattatctaagtttgctttcacattacaacaatagcagagtagttgcaatagagacgctatggtccccaaaactgaaactatttactatctggacccatacagtaaaagtttgccaaccactggtctagagtcagagttttcaagctgcaacagtatctcataagacaagttagatgtcctgaaatagccccggggagtctatgaagggtagagtcagaccttgagcagtgaaaatgacgacatctggggagatatggactcttctatcctttcagccagctgaagcacaattgcttctatcaatctattaatatcattttccactaagagggcaggtgtatcttggcttatcagtctgcatcacctggctgcccacacaatcagtttataagagaacaattatatcctaaagctaagttagaagtgggtatctatggaatcagtctgaattcattgaggaaaagatgagctgtgattgaaagataaagtattaacagaaacagagtgaactggggttggttggagaaccctgaaaaagaggggagcaacattaaagtgaagaaaatcacagtctaataggacaaaaggtttaggaagcaagctgagaagaggtgaagcacatacaatgaatggcagctacccacagatcatctcaaagctaccagtttctgctggtgggggcctccttgtatccttgccatgcacgctcccactggacttgtactattttaatcaattagctatgggttttcctatccttattttaatgtaatgagtgacttcctttttctccactatttgtgtcttaagaaatactatagcctagccattttcccatgggagcagttttctggcagtaaaatcatgcagaaattggagaattcactttattagaatcaactcagctatactgaatcatcttaaactttaaaacattactgaggcagaattaagtttatttcttcatcctaccataaaaataacatctttatacttattaagccttaagcctattagtatttaaaagacacttaatttactaacttttaaggttactcgttgaggttatagtcaaaactccaatatttgcttacaacgtgccctacaagaacactctatgtgtgcagacttccttttgagatttccttggaagcttcaagattaattctgatacaaattctattgatagaataatcagcaagagtacaaaaaagaagcttggaggtaaaaccaagaaagcataagtaaatggcatcatgcttattcaaaatgacctatagaaatgacagaaagcaaccacaaacaaaacttgaactgttttctgaaagaaacaaaggaaattatcttctagaaggctaagaagccaaagggggcagacatgttctctccctgctacctgaaagccaatcaaatctgtctgtagagcagtggaaaattaactctttgggcatctaggcatctctttgcataaattgatatatatgattgcttgctgcctttagagggggttgtggtcaaggagagtagaaaggaattttgacgagagtggggtgtagcagagaggttcttcataggagccaggcaggaaagaaaaacatggtgcttggaaaagctaggactaactactccccatgcagtcactaggactggccttgactctagtaaggagcggggagagagtagagaagaagctgaaagggatcattttcataggaattgtgtgtgactctaggtgcaatcattgcctcactggggcccatatgagagagtgcagcacagaattgggaagagaggcattctcccctcttttgtaggagcctagcgccattctaccacattgaggattggcagctgaaggagaccagagaatttcaccccaaaatatggtaccctggtatgtttattattattattattttgagacggagtttcgctcttgttgcccaggctgaagggcaatggtgcgatctcggctcactgcaacctccgtctcccaggttcaagcgattctcctaccttagcctcctgagtaggtgggattagattacaggcatgcaccaccacgcctggctaattttttgtatttttagtagagacaggtttctccatgttggtcaggctggtctcgaactcctgacctcaggtgatctgcctgcctcagcctcccaaagtactgggattacaggcatgagccactgcgcccagccgattattttaaattaaacacccctggggaccagcagacactggaaggagctttactttgatactccctaatctgcctaatgtccagactcgccaaagaaaaaaataattacttctggtcccttccctgagttttcatcaatttaataataactctaatcacaggcaggtagactgaagtctgtcaacacacctggacagacgtttgtcaaaaatcatgctctgcgggcccaacaaactttgtcccaggccactgtatgttctccaagtccactgaatttcccctaaaaatcatttactacaccccaagttgacacatttcccctatctcccctcctctatgaaaaagggtatataagcttctgtacccgttgggttatgaggtaatcattctcctactattcccctgtgttatgcacattgaaataaattttgtgtgtcttttctcctgttaatctgcctcttgtcagttgatttttcagcaaaacttcagagggcaaagaggaagcaatccctttgaccttacagatttggcattgttggtgggataaccaaaactgctctgctcctctagaagctgcagtcaaaggaacacaggacctgataggtgaacagaatgataagaaattcttaccagtcagactcccagtctctctctctgcataatctggtcaagcagacgagaaaaatcagtttgtctcttttttctttccaaatttaagattaatgggagaaaagcatttgtatgactagtcttagatgtaatgactctggtatatttttgctatgaatattcatattgtccatccttttcctcacagaagtagtctttattttttcctttgtctctgtctttctgtgaagagtccctcttgttttatgtccttgagagcttgacttttgaccacgtaggagccctatctcttggtctctgccatccagtgggcatgatttttgggccacgtctggtggccagcctaaaaggactaggaacccggaggtacctaagatattaagcagcacactctgttccaaatgtgccaagctctcagcaaagtttttcttaaataagaaatcccatccataaggggcttttgttgtcctaactcttgttgcctggatagtcctggaaagtccaatcccaggaggacctactcagtgtcacagattaacagatctatgactggtgcccctccctcctcaatactggaggcaccatatgaacaaacacctcctcaaccatctgtcacaagtgtcctttgctatattagactttttctgaaagtgaattttgaggggatcatgagaactacatcatcttcccatttttatactgccacttatactgtccatgatagtctaaacctggaaagctacctctgagactccatgaaaatggctcattaacttgagtcatttatggaataaataaattggctatacttaaaagaaaactttttagagagtgcttgtcttaaacagctatcttattcgtacctatttttaaaaatattaaaggaatatagccttagaaattctcttagtaagatttttaaagcagaaataatattcaaaggaaacttaaaatcctgtacactcaattgcctgctttggatccatctaggatctgcaaaaagcactctggcctatggtctaatggctaggattccactgtttcattgcctcaactcaggtttgatttctagtcagggaaccagccccttggagatgtaaatcctttaactcaggggaaaaaggaaacatttataaaaattagtttgagggtcaggcacggtggcttatgcctgtaatcccagcactttgagaggctgaggcaggaggatcgctggagcccaggagtttgagactagcctgaaacagatcccttctctacaaaaaattaatttaaaaaattagccaggtgtggtggcatgcatctgtagtctcaaatactcaggagactgagacaggaggatggcttgagcccagagatcaaggctgctatgagccatgattacaccacttcactttagcctgggcaacagagcaaaaccctgtctcaaaaaaaaaaaaaaaagaagtttgaattacttattttgaatttatatttgtgtgacccttgactttttggggtacccatttgtcattgatctttttcccttccatggacagttatgttcctgttcatcactaagtctctattttcttccagaggtctttgtggggtggctctggattttgtgaagactgcttctttgtacctctttggagatgtcttgtgctcccttggttaaatcataaatggcttttttggttctgaatcacttggtagttacctttggtttaaaagaaaaaaaactgaagttcagataaataaagttttaaaaaaataaagtttacttctccttcctttctctacgtctgatacacatgaagggatctagatgggactttgagtgaccctgaagcctcttgagaaccacaacaaaaaggtaccactgactccctgttttggggttctctgttttcctcatggagactcaaaagtcgtgaatgggttcctctcaggtctgaaatctctactcttttttgcattaaactccctcatctatttgacttttgtatacatacatgtatacgtgtgtgttgtatgttgtgtctacatgtatgtgtctatacatgtgtttgcatattatctacatgatatcaaattgacttaaaaataaatgagtactcataaattatataactagcccaaaacttttcaagttcccttgactttaataaatctttggtaaataaagctagttttaaaattgctagtaaaataaaaatgtcttcaaaatttaatttagacatttttgcctaggtctactggtcacacaggtttatgctacctctgttagatgttttaaggtcataaaactgttgtttctatgatattcttgatattttcttgatttgtatataaactaaaactgtaagtgctggctgctgggctcccaaaagtcttacacacatcctactgtggcttgttgagccaagcccaatatggccccatcctccctggtccagctctgcctcctggtcatgctgagaggggtcagatcctcccaacattgtcttcacaagtccgtcctctgccctgggccctatattaggtgtgcaaatccaggattcagacaggtcctacccttcgtagtcatcctgggtgccacatgggtactcagaacccaggacaactagagtagggacaatggggagggacctgtgtccagtatctcaaaggccttagttaagataaaattagctgatgctggttttgctttttcaaaaaaaatacataataacctaaataaatagctttattttccatgaataattcaaatataactgttaaaaaatatttttcaataatttaaaatcttaaggacatgttatgttaagtagtagagaatcatgaaatgtttgagtcatttctaagtaagttaaaatactaaaacattaattattaagcatagtttagataattttgacatcttgttcttatatggcatagaaaagctaaatatatctgtatctgttaatgagcaaaaaactgatgaaacatctttctaaaaattataaaattgttttcatttacaaacactgatataaaacagttcaaaattacttacttcctaggttttcagtagaaactagggttactaagagttactattataattagtatataattaaaactactgtatatgataaacaactatgtatggagtatgtaagggaagtaaaatgttataaggtatgaggatgtgcttttgttgagaaaaagcaatttcatatagttcagagattatgtaaaggttgtttcaaaatgagaaaaatgatataaataaaactaaatgggtatagaaagttgagaaagagagaatttcaaaataattaaggtgaatgaaatatttaatatttaatattaaatttatttaaaatttactatttgtttttaaactgagccttaaaatcaaaaatagtctacaaaactagaattttattttctcctttgaacaagattttcatatagtatcaataagaaatagtaaacgactttggttcacattttgagtaaactgcaaaaaaaaaaaaaggggagaaacagcttttgtgtgcctcatgctatcttaataggtcttttgagtatttgaaaaactaagtctcatctctgtcaaactgtcaaagagtaaaggttttggcttttggaaatcctttattacaccagctaaatgaatgactttatttcacagtaatttttgatcaaatattttaaatgtttgacatacttgacaagcttcccaaaatcaaccttcaaattctaaagtaagtctttttgacttcaaactaactttgggattttcccaaagacccctgaagtatccaaaagagaaataataaacaggtttagtttatatattaaattatatgggaagaactgtcaaataacaaataatgtttaaccttttttctgagttatatttatatggctatcttgttagtatgtgttccaaaactgtatgagatttcttaaaatatgatatatcttggtatatgttgtcattcataattatgagtgttatgttgaattgttgtaggccacaaaaaaaagaccaaatatctttgtcaattgtttatttaaccatggccattttaagtcccattgtccacagttaattgttttattctgatgctttttttttcttgaaagctcttcccaaatcctgaagtatgggtcttcaaagaagttcatgggaataacactgacaaataaaggtttctgacaactctgaaactgtataagtgaatcaatgaactgtgtaaaaattccagaactctaataaaaaaaaaaactggactcataaaattgctaaactaccatcaagcagaacaataattaattacatgggactgaactgataaaagactgaaatgattatttatgattttttatttaggctaattatttttatgttttgttctccagagttaaaaaaaaaacaacaactttttaaaggctacaattcccctgtgttatgcacactgaaataaattttatatgtcctttctcctattaatctgccttttctcaattgatttttcacccgaacttccagagggcaaaggagaaatttggccttcacccctacactgctttgaagccactaggacatggctaccttggcatgttcatttccagtttcccagagtaccaccagcagcagtcaccatccaccagcaataagctgaagccagacaaaactggaatacacggcagatacgctggtttgggagcacaagtgagtcataattcagagacttcaaaatttggaaatgcaggaatgaacagaagagaaaagaggttttataggaaaatccccactctagcacaagcaagtgaggtcaattacaggaactctggattgctgctgctaatgggacttcctttgaacttgcaagggtagagtaggaggccagggaatcagattacataaggataagcatctggcctacatggcccagtggtctgggaactgaaaacaatgagtcccacagaggctgaagtataattctgagaatagaatgtagtttggaaactgaaaaaaatctgttaaaaccctggcaactaggtaatcttattgttcctgaacagcaggagtttgtgaatccaaacctgaaaatgccacattcactatgactcaactcttccccttgtttctactttctgtgtatctttcagctttgcacctaatagaactgtttaaccctaggtactaactgcttaaatctcagaatatagtcaactcctcaaaaagaggatgctaacgggaccaattcataatcatcccccagaggcagagctctcatggcagagcacgtcacagggttcttgccaacctataactgagtgtcactaagtcagttgcccaccctgataaagttagctgtaacaagggtgccaaagtgtcttgagagcattatggagacttaacaaaaggaacccctaaaaagaaggcaaagggaatgtaatagttattaaggctgttcacaaatattcccattgtcctctgggcacagggcaggatcacatacccaacatccactttgaccacataacttgctttgacaaaagcaatgtaaatagaggattgacatatgtcatgtccaggtgaacattttaggagttctcgcatgatttatcatgttccatttccccagttgcaatgacagtggaagcacatgttgagataagtctatattagcctgggtctctgagtgcctgtctcaagcagaaaccccagctcacattgaacatgtagcttgagcaggaaataaattttattaagcctctgagatttgggggttgtcttcttatcacagcacaaccttgcttatgctgactaatacaggggctggtaggtaaacttgccccagtgagtattaaaagctatccccaaggggacaggtgggagacactatggaggtagaaatgaaaaaaaggccaagaggtcctacaatacttagaggtgaacgacaaagaaataatgtttattactgttcttctaactctagatttacttcttgaaaacatgggatatatttacagtcagaaaatacatttgacctttgcccttcaaaaaaaaactttacaaaagataacacattataaagagtttgttattactattattttaagggattttgagtaagtcaattcttttaactcacattcaacataaatctgacacctaccaaactgtattttgcagcaaataagattatagacagtttcattatataatgactgtagcatgatctagcagtttatatccccttcagagagtatacaacatagagatgtaaattctttgaagcacaattctgcataaatagactttctgcattgcattgccaaacttggatcttgaaagtgataaagtgcagatgcctacagttgcagtcataaaaatgtaattgctgagaaattatttctgatccattggaagaatttattacagagggatgcaactgtgtaagttatcacacaagaaactgaaagtgaatgattgaaatatatcccaggctaaatatccctgcaaaatgacccaagagaaaaaaatctctgtgcccaagagaaaaaaaaaatacattaaagataaatcaggtttggtagggaagaatttggtaaccataaaagagcagaataaagatttatgaagaaatgaattcagaagttagagtgacataatagtatctatgaccaattactccaaaaattaaaatgtaattttgactttgagttatatacagaggtgataagtaatttctgtggaaccctggaagcaaaggaatataacatgaagataaatcatgaggaaagtgaagaaatttttaatgggactactgaattaataactttagctggtggcaatgtgaacttaaagacatgaacttcttttggaatgttttccagtgaaatcagagactatatcatgtacttaaaccatgtaactatttcaaattaaacactctttgtaacagtagccaaaatatgggaacaaccatctacagatgaatgaataaagaaaatgtggtgtttatgcaatcgaatactattcagtcataaaaaaaagtaaatcctgccattttctaacatggatgaacctggaggacattatgctaaatggaataagccagacacagaaaggcaaatactgtatgatctcacttatatgtgaaatctaaaaaagttaaattcaaagaagcagagggtaaaagggtggtttccaggtgctagcgaattggggaaatggggaagattgttgatcaaaggatataaaatttcagttttaagatgaataagttttgggactctactgtgtagcatggtgactatagttaacatattgtattctttacttgaaatttgataagaaagtagattttaagtgtcttagccacacacacacacacacacacacacacacacacacacacagtggtaactatgggtagagatggatgtgttaattcatttgactgtggtaatcattacacattgcatacatacatcaaatcatcacatcgtacaccctgaatgtacagaatttttatttgcctcattacctgtccattaaatatattaaaaaaaaaaaacactccttctcctcctcccctggggtagatggcggcggctagatttggagccccaacctcgctgccggcaccaagatggacaattagaagcagctgcggtctgcgcactcagagaggaaggaaaggagcaagtgaattcagcaccttcaactgaagtatccaggttcttgcattagggctgactaggcaaacaatttgacccacgaagaacaaagaaaagcagggtggggcgatggtccacctgggagcagcacggagccaaatgaacccccaccctgagccaagtaaagcagtaagtgattgtgagaccccacctggaaaaccacgcttttcccacggatctttgtaatccgtggatcaggagatcctctcgtgagcccacaccaccagggcgttgggtctgatacacagaactgtgtagaatgttggcaaagcagccgtccaggcacacacagagacccaggagttttccacactccagccccaggatccctggcaagacgagagatctgtccgtatatatccctaggaagggggctaaaaccagggagccaaacagcgtcattctgcaggcctgctcccacagcaccccacaagttaagacccactgattggaattccagccagccaatggcaacaggctgagatgagaccaagttccttgcgggaggggcggccaccatctccatggttcagtcgactcagccattccagcctgatggctttggagaatacaaatggtccagacaaagaagggtccccgacaatagcacagctgccttgccagattatagccagactgattctttaagtaggaccccaatccattcctcctcacagggtgggacctccctgtgggggtttcagccaccccagcaagggctctacagacaaagccctgatctctccctgggatggagctctcaggaggaggggttgccacaccatctctgtggttcagtggactcagccattctagcctgccagctttggagaatacaaacggtccagatgaagaaggatccctcactccccgccccaacgcagcatatctgctccaccagaaagcatccagactgcttctgatcccattcctcctgaccaagtgagccctcccaacaggagtctacagacacttcctacaggcacattaggaacagcaacatgtcagtacccccactgggacagagcttccagaagaaggagcaggctgctgtctttgttgtttcacagccttcactggtgatacttccaggtaaggaaaactgaggcaactagggtctggagtggacccccagcaaaccacagcagcccaacagaagagtgacctgactgttaaaagaaaaacaaacagaaaacaacacaacaccaacaaaaaagaccccataaaaaccccattaaaagtgagcttgaagactatcttgctgaaatagagcaggaagacaagattagagaaaaaagagtgaaaaggaaaaaacaaaacctctgagaactacaggaatacataaaaagaccaaacctatgactgattggagtacctgaaagagacagggaggatggaaccaagttggaaaacacagttcaggatatcatccaggagaacttccccaacctagcaaaacaggccaacatataaattcagggaatgcagagaaccccagtaagatgctccatgagaagatcaaccccaagacaaataatcgtcagattcttcaaggttaaaatgaaagaaaaaatgtcaagtgtagccagaaagaaaggccaggtcacctacaaagggaagcccatcagactaacagcagaccactcagtggaaaccctacaaggcagaagagattgggggccaatatttaacattcttaaagaaaaaaattccaacccagaatttcatatctggccatactaagcttcataaatgaagaagaaataagatccttttcagacaggcaaatgctgagggaatttgtcaccattcagtctgccttgcaagagctcctaaaggaagcactaaatatggaaaagaaaaagcattatcagccactaaaaaacacactgaagtacacagaccagtgacactattaagcaactacataaacaagtctgcaaaataaccagctagcatcatgatgataagatcagattcacacaacaagattaaccttaaatgtaaatgggctaaatgttccaattaaaagacacagaatgacaagttggataaagagccaagacccatcacagtgctgtcttcaagtgacccatctcacatgcaaagacacacatcagctcaaaataaagggatggaggaaaatttaccaagcaaatggaaaacagaaaaaaagcagaggttgcaatcctagtttctgacaaaatagactttagaacaacaaagatcaaaaaagacaaagaagggcattacataatgataaagggttcaaactgacaagaaaagctaactatcctatatacatacacacaatatgggagcacccagatgcacaaagcaagtccttagaaacctataaagatacttagattgggaaatttaaataccccactgacaatattagacagatcatcaagacagaaaattaacaaagatattcaggacctgaactcagctctggatcaagtagacctaatagatatctacagaactctccacccaaaaacaacagaatatatattcttctcattcaccacagagaatactataatcacctctatgcacataaactagaaaatctagaagaaatggataaactcctggacacatacaccctcccaagactgaaccaggaaaaaactgaatgcctgaatagaccaataatgagttctgaaattgaggcagcaataaatagcctaccaaccaaaaaaaaggcccatgaccagaaggatttatagctgaattctaccagaggtacaaaaaggactggtatcatttctactaaaactattcaaaaaattgaaaagaagggactcctctctaactcattctatgaggccagcatcatcctgataaaatctggcagagatacaaccaaacaaataaaacttcaggccaaaatctttgatgaacatcgatacaaaaatcttcaataatatactggcaaactgaatcgaagagaacatcaaaaaaattatccaccatgatcgagttgtcttcatccctgggatgcaaggttggttcaacatatgcaaatcaacaaatgtgactcatcacataaacagaactaaagacaaaaaccacatgattatctcaatagacgtagaaaaggacatcaataaaattcaacatcccttcatgttaaaaactctcaataaactaggtattgaaggaatatacctcaaaaaaataaccatctatgacaaacccacagccaatatcatactaaatgggcaaaagctggaagcattccccttgaaaacgcacaagacaaggatgccctctcttaccactcctattcaacatagtatcaaaagttctggccaggacaataaggccaagaaaaagaaataaagagtatccaagcaggaagagagaaagtcaaattatctttatttgcagatgacatgatcctatatctagaaaaagcccattgtatcagcccaaaagctccttaagctgataagcaacttcagcaaagtctcaggatataaaatcaccgtgcaaaaattgctagcattcctatacatgaacaataggcaatcagagagccaaatcatgaatgaactcccaattatgattgctacaaaaataataaaagatctaagaacacagctaacaagggaagtgaaagccttcttcaaggagaactacaaatcactgctcaaagaaatcagagaggacacaaacaaacggaaaatcattccatcctcatggataggaagaatcaatgtcgttagaatggccatactgcccaaagcaatttatagattcactgctattcctattaaactaccactgacattcttcacagaattagaaaaaaaactattttaaaatgtatttggaaccaaaaaacagctcaaatagccaagacaatcctaagcaaaaagaacaaagctggaggcttcacactacccaaattcaaactatactacagggctacagtaaccaaaacagcatggtactggtataaaaacagacacgtagaccaatggaacagaatagggaactcagaaataagaccacaaacctacaaccatctgatcttcgacaaacctgacaaaaacaagcaatggggaaaagatttcctatttaataaatagtgctgggagaactggctagccacatgcagaaaattgaaactggacccctaccttacaccatatacaaaaagtaacccagaggaaagatcaggcagcaacatttgctgttcaccaatattcgctgttctgcagactccactgctgatacccaggaaaacaaggtctggagtggacctccagcaaactccaacagacctgcagctgagggtcctgaatgttagaaggaaaactaataaacggaaaggacatccacaccaaaaccccatctgtacgtcaccatcatcaaagaccaaaggtagataaaaccacaaagatggggaaaaaacagagcagaaaaactgaaaattctaaaaatcagagcacctctcctactccaaaggaatgcagctcctcactagcaacgtaacaaagctgcatggagaatgactttgatgagttgagagaagaagacttcagatgatcaaacttctccgagctaaaggaggaagttcgaacccatggcaaagaagttaaaaaccttgaaaaaagattaaacgaatggctaactagaatacccaacgcagagaagttcttaaaggacctgatggagctgaaaaccatgacactagaactacgtgacgaatgcacaagcttcggcagctgattcgatcaactggaagaaagggtatcagtgatggaacatcaaatgaatgaaatgaagcaagaagagaagtttagagaaaaaagaataaaaagaaatgaacaaagcctccaagaaatatcagactatgtgaaaagaccatatctatgtctgattcgtgtacctgaaagtgacgggcagaatggaaccaagttggaaaacactctgcaggatattatccagaagaacttccccaatctagcaaggcaggccaacattcaaattcaggaaatacagagaataccacaaagatattcctcaggaagagcaactccaagacacataattgtcagattcaccaaagttgaaatgaaggaaaaaatggtaagggcagccagagagaaaggtcgggttacccacaaagggaagcccatcagactaatagctgatctctcggcagaaactctacaagccagaagagagtgggggccaatattcaacattcttaaagaaaagaatttttaacccagaatttcatatccagccaaactaaacttcataagtgaaggagaaataaaacactttacagacaagcaaatgctgagagattttgtcaccaacaggcctgcctaaaagagctcctgaaggaagcactaaacatgggaaggaacaactggtaccagccactgcaaaaacatgccaaattgtaaagaccatcaaggctaggaagtaactgcatcaactaatgagcaaaataaccagctaacatcataatgacaggatcaaattcacacataacaatattaaccttaaatgtaaatgggctaaacactccaattaaaagacacagactggcaaattggataaagagtcaagacccatcagtgtgctgcattcaggaaacccatctcacgtgcagagacacacataggctcaaaataaagggatggaggaagatctaccaagcaaatggaaaacaaaaaaaggcaggggttgcaatcctagtctctgataagacagactttaaaccaacaaagatcaaaacagacaaagaaggccattacataatggtaaagggatcaattcaacaagaagagctttctaaatatatatgcacccaatacaggagcacccagattcataaagcaagtccttagagacctataaagagacttagactcccacacaataataatgggagactttaacaccccactgtcaacattagacagatcagtgagacagaaagttaacaaggatatccaggaattgaactcagctctgcaccaagaggacctaatagacatctacagagctctccaccccaaatcaacagaatatacattcttctcagcaccgcactgcacttattacaaaattgaccacatagttggaagtaaagcactcctcagcaaatgtaaaagaacagaaatcataacaaactgtctctcagaccacagtgcaatcaaactagaactcaggattaagaaactcactcaaaaccactcaactacatggaaactgaacaacctgctcctgaatgactactgggtacataacaaaatgaaggcagaaataaagatgttctttgaaaccaatgagaacaagatacaacataccagaatctctgcgacacatttaaagcagtgtgtagagggaaatttatagcactaaatgcccacaagagaaagcaggaaagatctaaaattgacaccctaacatcacaattaaaagaactagagaagcaagagcaaacacattcaaaagctagcagaaagcaagaaataagtaagatcagagcagaactgaaggaaatagacacataaaaaacccttcaaaaaattaatgaatccaggagctggttttttgaaaaggtcaacaaaattaatagactgctagcaagactaataaagaagaaaaagaagaatcaaatagacccaataaaaaatgataaaggggatatcaccgccaatcccacagaaatacaaactaccatcagagaatactataaacacctgtatgcaaataaactagaaaatctcaaagaaatggataaattcctcgacacatacaccctcccaagactaaaccaggaagaagttgaatctctgaatagaccaataaaaggccctgaaattgaggcaataattaatagcttaccaaccaaaaaaagtccaggaccagacagattcacagccgaattctaccagaggtatgaggaggagctggtaccattccttctgaaactattccaatcaacagaaaaagagggaatcctccctaactcattttatgaggccagcatcatcctgataccaaagcctggcagagacataacaaacaaagagaattttagaccaatatctctcatgaacatcgatgcaaaaatcctcaataaaatactggcaaaccgaatccagcaacacatcaaaaaccttatccaccatgatctagtgggcttcatccctgggatgcaaggctggttcaacatacacaaatcaataaatgtaattcagcatataaacagaaccaacgacaaaaaccacatgattatctcaatagatgcagaaaaggcctttcacaaaattcaacagcccttcatgctaaaaactctcaataaattacgtattgatgggacatatctcaacataataagagctatttatgaccaaccgacagccaatatcatactgaatgggcaaaaactggaagaattccatttgaaaactggcacaagtcagggatgccctctctcaccactcctattcaacatagtgttggaagttctggccagggcaatcaggcagaaggaaataaagggtattcaattaggaaaacaggaagtcaaactgtccctgtttgcagatggcatgattgtatatctagaaaaccccattgtctcagcccaaaatatccttaagctcataagcaactacagcaaagtctcaggatacaaaatcaatgtgcaaaaatcacaagcattcttatacaccaataacaaacaaacagagagccaaatcatgagtgaactcccattcacaattgcttcaaagagaataaaatacctaggaatccaacttacaagggatgtgaaggatctcttcaaggagaactacaaaccactgctcaatgaaataaaagaggatacaaacaaatggaagaacattccatgctcatggataggaagaatcaatatcatgaaaatggccatactgcccaaggtaatttatatattcaatgccatccccatcaagctaccaatgactttcttcacagaattgggaaaaactactttaaagttcatatggaaccaaaaaagagcctgcattgccaagtcaatcctaagccaaaagaacaaagctggaggcatcacactacctgacttcaaactatactacaagactacagtaaccaaaacagcatggtactggtaccaaaacagagatatcgaccaatggaacagaacagagccctcagaaataatgccacacaagtacaaccatctgatctttgacaaacctgacaaaaacaagaaatggggaaacgattccctatttaataaatggtgctgggaaaactggctagccatatatagaaagctgaaactggatcccttccttacaccttatacaaaaattaattcaagaaggattaaagacttaaatgttagacccaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttccgcacagcaaaagaaactaccatcagagtgaataggcaacctacagaatgggagaaaatttttgcaatctagtcatctgacaaagggctaatatccagaatctgcaaagaactccaacaaatttacaagaaaaaaaacaaacaaccccatcaaaaagtgggcaaaggatatgaacagacacttctcaaaagaagacatttatgcagccaaaagacacatgaaaaaatgctcatcatcactggccatcagagaaatgcaaatcaaaaccacaatgagataccatctcacaccagttagaatggcaatcattaaaaagtcaggaaaaaacaggtgctagagaggatgtggagaaataggaacacttttacactattggtgggactgtaaactacttcaaccattgtggaggtcagtgtggtgattcctcaggggtctagaactagaaataccatttgacccagccatcccattactgggtatatacccaaaggattataaatcatgctactataaagacacatgcacacgtatgtttactgcagcactattcacaatagcaaagacttggaaccaacccaaatgtccaacaatgatagactggattaagaaaatgtggcacatatacaccatggaatagtatgcagccataaaaaatgatgagttcatgtcctttgtagggacatggatgaagctggaaaccatcattctcagcaaactatcgcaaggacaaaaaaccaaacaccacgtgttctcactcataggtgggaattgaacaatgagaacacttggacacaggaaggggaacatcacacacctgggcctgtcgtggggtagccgggagcggggagtgatagcattaggaggtatacctaatgtaaatgacaagttaatgggtgcagcacaccaacatggcacatgtatacatatgtaacaaacctgcacattgtgcacatgtactctaaaacttaaagcaaataaaaaaacaataataataattaaaaaacccaagatggattaaatatttaaatgtaaaacccaaaactataaaaaccctagaagaaaattgaggcaatagcattcaggacataggcaaaggcaaagatttcatgatgaaaatgccaaaagcaattgcagcaaaagcaaaaacagacaaatgggttctaattaaactaaagagtttcctcacagcaaaagaaattatcatcagagtgaacagacaacctacagaatgggagaaaatttttgcaatctattcatctggcaaaggtctaatatccagagtctacaaggaacttaaacaaatttacaagaaaaaaaaaacattaaaaagtgggcaaaagacatgaacagacacttctcaaaagaagacatacatgcggccaataaacatgaaaaaaagtttatcagctgggtgcggtggctcatgcctgcaatcccagcactttgggagactgaggcaggtggatcacctgaggtcaggagttcgagaccagcctagccaacatggtgaaaccccgtgtctactaagaatacaaaaattaaccgggtatggtggcatgtgcctgtaaatccagctaccaggaagctgatgcaggagaatcactgaaacccagcaggtagaggttgcagtgagctgagatcatgccactgcactccagcctgggtgacagagcaagactctgtctcaaaaaaaaaaagttcaacatcactgatcatcggagaaatgcaaatcaaaatgacaatgagctaccatctcattgtcagaatgcttattaaaaagtcaaaaaacaacagatgctgacaaggttgcagagaaaaaggaatgcttttacattgttggtgggtatgtaaattagttcaaacattgtggaagacagcgtggcgatttctcaaagacctagatgcagaaataccatttgactcagcaatcccattactgggtatatacccaaaggaatatatatcattccattataaagatacatgcacatgcatgttcactgcagcactattcacaatagcaaagacatggaatcaacctaaacgcccatcagtgatagactggataaagaaaatgtggtacatatataccatggaatactatgcagtcataaaaaagaacaagttcacgtcctttgtagggacatggatggagttggaagtcattatcctcagcaaactaatgcaggaacagaaaaccaaacaccacatgttctcacttataagtgggagctgaaggatgagaacacatggactcatggggggaacacactggggtctgtcagcaggggtgggaggagggagagcatcaggaagaatagctaatggacgctgggcttaatacctaggtgatgggatgatctgtgcagccaaccaccatggcacgtgtttacctatgtaacaaacctgcacatcctgcacatgtactcctgaacttaaaataaaagttgatgaaaaataaatactgaggtctacttagtcttttcaaataaacaggttactctttttttttcttttattataccttaagttctgggatacatatgcagaacgtgcaggtttgttacataggtatacacatgccatggtggtttgctgcatccatcaacccatcatctacattaggtatttctcctaatgctatccctcccctagcccccacctcccaacaggccccagtatgtgatgttcccctccctgtgtccatgtgttctcattgttcaacttccacttatgagtgagaatatgtggcgcttggttttctcttcttgtgttagtttgctgaaaatgatggtttccagcttcatccatgtccctgcaaaggacatgaactcatccttttttatggctgcatagtattcaatggtgtatatgtgccacattttctttatccagtctatcattgatgggcatctgggttggttccaagtctttgctattgtgaatagtgctcccataaacatacgtgtgcatgtgtatttatagtagaatgatttataatcctttggatatatacccagtaacaagatggctgggtcaaatggtatttctggttctagatccttgaggaattgccacattgccttccacaatggttgaactaatttacactcccaccaacagtgtaaaagcattcctatttctccatgtcctctccagcatctgttgtttcctgactttttaatgatcaccattctaactggcgtgagatggtatctcattgtggttttgatttgcatttctctaatgaccagtgatgatgagctttttttcatatgtttgttggccacataaatgtcttcttttgagaagtgtctgttcctatccttcgtccgctttttgatggagttgtttgttttttcttgtaaattttaaacagctattcttatctaaaaaaataaaaataaacactttttgaaaaacaaaaaagaatgtaatgagacacttaacatgatgttatcctagaaaaaaaaacctttaatataatttaatgagatattttatttgtgttggtgggttatacatgatcaaagtgacagatacaagaaggctgaacatcaaatccagaaagatcagttattttaaaatataactctttgactttgaaatgtactggtttttgataaggagaatcccattattaaaaaaacaagagtgtatacaaataatttagttaaatagaattctgctttataagatagttattgcataagttgatattatataaattattaatattttaatttaatatcacttgagtattgctaagaccataaaatcatttttatacctgagacgttgatgttttataccaaagtacttttaagaaatcagtgactattttgaaaacattgacatcaatcttaaggaagacaaaattagcaattatatttacatgtaacagaactgtctggtatgtaaaaggtaatgagttccatttctgtgactcatctacttgtggatcatgaaaagtttgaatccaagaacatcaaaagccctctaaaactagtataatcacactttttaaaagagatacatttctttccaatcaaacaagattactcaggtcattttcatccttctaattttataggtgaactcaataaatgtttatagatggttattatctatttagaacatgccataaaatgtgcacgtgcgcgcacacacacacacacacacactgtgactagcattaccctttaatgtgaatttacttagaatactttctattaacttctttagcaatgtacttgactaaagcaaaatatctattagtttcagttagaatataaaaagtagtttccccatgatactctctctgtttataagcaatatgtcagcaacctttgtgattagcaagttttaagtgaccaactgtaatgttccattgttatagagcaaataagggttataaactagcattaatgtatttgttttcaccagccatctccgaaatgaaggtcatttccctattcctactccttataattggataggaacaaaaccttaaatgacttgtgagaactcatttaaaactgtccccaaaaaacttggtgatatgtatgaaaaagtataaaaatattcatatcttggccattaacttttacatttgtaactaattctagtgaaataatacaaattgatgacaaaaatgtatatacaaagatgttcagcagagcaatatttataataggaaaaaaatagaaacaccctaaatgtccaaaaatgtgaggctactttaaaaaaactgtagtgcagccatatcatatataagtaaatagcagctttattaaaccatgcttacaaataaatagggaaattattaaaatatcatttaaaatggaaaagtgggattaaaccctgcatatatagtactagctccacttgttaatatatatatattcttcatatatatatatataatatatatacgtgtaaggatatatataaagaagatatattctttaatattacaaagtacaaagatgataaaaatctcccacaactttattgtactggaagtaaacgcaccaaaacattaatgtttatctcttggtaaaattatgagtgtttttattcttttttttaactttttttgacattccaatttttttgtgaacttcattagaaaaacaaatgagggtttttctttctttttttttttttttaaacagggtctcactatgttgcccaggctggtctttaactcctggacttaagcgatcctcctgccttggcctcccaaagtgctgggattatacacatgagccactgcacccagccttttttctttttaacatgaaactgtttagtgagtggctaagacggactttaatgaagtctccacagtcatctagtataaatttcacaccagatattagtgccgttaagactgccaaagttaactattaaggtatcatcagggatgcacatgttttgaattgtctttcgagtagcagatatcaacttgtacaacatgtacaaattgataaaaatatgtaaacttgtaaaaatatatacaaagtctattctcagagctactcccctccccacatccatctcacaaaaaagataagcagaacatatttaaattatctgaggaaaggtcggcatagtttttcacccaagtaacccttgggttctttgagtccctaggaaaagggacttgaatcttgtattaggaggcaagatgtaaggcaggcctaaaggggagttccctcacaaattgtgggttaatgacaaaaatttaaatctataccactgcataagtttcttcaagccctgctctaagaaaatccaatacatgaaatctcgacttacataataaaaaaagtcagagaatcattatgcatatcatcaaaggattattcaccttatgaaagacttcatcacagaattcctttaaatagctgcttttctcatacattttagtattttaaaggtagtttcccatttggcaaatgagatgccatgtgcctgaggcaagttagtgaaattctctaggcctcagtttcctcatctatgtaataaagatggttttaaccatgttacctgcctcattcagttttcacgattatcaaagaagataatttatataaaggtactctgaaaattatatatatatatatatatatatatatatattattactgctattcttgctaaaagagaatgtgggggaaactttcagaatacatactttttcacatcttaacaacacacatacctacttttcacatcttaacaactctttaaaggacaattttagatgacatatttatatataaaaatcaaatcttttattcttcattattcatttttcccacatatttttcattcttctgcagttactatatatcataatttccatggtattaatacctggattatgagaggctccagtagcttctccacggtgaatgtttggacctgcagatcctgaggatcgatattcaatgtgattggtgtttcagctgacatgctgcctgtgcacaaacacaaaaggatgcttattaataaagaaaactgttttctaaagaagaacacttatgaaatcatggaataggtaaaacttgtattcagcacctcttcctgatatcaaccatagccctcagaggaccaggctacaaaatctaccttcagagaaagaagatattccccaactgttccctgaggtcatgctgcctgggcttaggtcctgtaacaaattaatctacacaagtatgttcatgattaaattaacaactcatccggggtgggtttgtatttgatcagtagtcttaagtgatcagaaaggtaagacacatcttacagcattcaagtcctttggcttctgtgaaatcacagcactgaggcagcctatgcccatattttgcttcttcttgttaatgatgacttagacaaggaacaagtaaacctttgaaagacatgggaacaagtaaagatatgtccttacttgatttagagattgtttatttgagggttttgattggagaaggttaaaggcaatttaccttcttggacaggaaaagaaactaatacaaattgcacagttgttgtaaaaagagagaagcccctgagaaggcattgatatttggtcaagacaaaataagaagaaaaaaaagaattgcaagccattctctaaggcattaacgttatccttaaaaatcaattcagtgagatttttgcctaacaatatacatttataccaaatgaccatatgtggcatgtcatagtcggattaacgttcaaaaactctagccatattttcaaatagctataatatattatttattaatctactaaaaactacagtaagtgttaagaattttagatgaaacccactggcatcgttgattgcaaagagagagcacacttcctgaaatgtagcacatttctagatagttctctttctcttattgaaaataacccaaatggcctgcccagggccccatttgccccttcaaacctgccaagtgtgtccttgttcctagtctgtgcttaactctatcacaagccacttacagggtggctacaattcctttactttttgaaagattttgccttgaaaaaataattattcaaattctattaagtgaaaagatattacttgagtttcttctcaaatcaaagtttcaaattactgttattggcatatgatacatcaacatataaagtcaaagccctacaatttagccctgttttaccttgtttctctctcctttgcgttgatttcattctccttctaaaagtagaaacatggtctcttttctcagcgattcagctgcaatgtaagagacacgcttcaagaaaggctccaaacactattgccaaatggtttctctcaaatgcatttctagaactgaaatgttttagtttggtttggttttgattttgctttttcaatcatttcacctaccactttgattccttctaacacagggaaatctaaattgacagatagcctattcctgtggtgacctttctgcatagcccagagccaatctgtgcaataggatatgtccttcagtgtatagccttagggttctatcaaataagtgctcacaaaagaatttatttgttactcctctacgacaggtactatcctacataaaaatcaagtcaagatttctgccattgctttgttctttcatctgaaggacaaaagtagaggagactgttgtgaactaaaataaaatttggtgaaccttcgcagcctttaaaaacatgtcattttcaccgtgaaattcacgactggtttccaaagctacatggccaccagaaattgaaagtaaggaagataaaaaattaaggagagcaaaaattatccatatcatatgtaaatccttctagaagaatttttcaacctagaaggagctttctaaaaggagtgctttttagccaagagataaaagacaacctaatttagccaaagtatcttttaagtctgtgttcatgtctttaacacaaattaagtaaaagtttttcaaaagttcatttttccatggtaaaaattacttaaaaaaaataaatccttaaagaacttggcttcatataattattaatctttaaataaatgctatttcttatttttaaaaagtcttcctgctcttttgtatgtcctggtcagtattcctgactgattggaaattagggctatcataggcagaaaactgcataattttgcaaatgaaattgaagcaaagtcaaaatctgacaaatttgtagatatagcaataccacaacgcaaatccaaaacaaaaatcctactaggttgtaagtattacattctgaggcatttgcattttattttgttttatttttgagactgagttttgctcttgttgcccaggctggagtacaatggcctgatctcggctcaccacaacctccgcctcccaagttcaagtgattctcctgcctcagcctcccaagtagctgggattacaggcatgcacctccacgcctggctaattttgtatgtttagtagagacagggtttctccatgttggtcacgctggtcttgaactcctgacctcaggtgatccgcccgcctcaccctcccaaagtgctaggattacaggcgtgagccaccaccctggccggcatttgcattttgtaatctataaaatcttaggagttaggcagtacctcccaaacgattcaagaataccttctacacaaccttcatttcaccaacacactgggcttggatgaatagaaatgatgagaagcttactataccattagatgctcgttgagttgaaacctgccacttttaaacttttatccaaaagagatggcttaataaaggggaaaaagtacgctttataaataaagtaagaaaagtacagatttggagagagactataacaaaattccagttttcagaattaaaggaaggagaacaaatctcttgacagtggtgatagatgtctccagagaaagacaccaaggcagggcaaacccaaccatatggatccttcccttctccccaaactatctttgtctgcaatgactcaattttcttcattccactttattccctgctggaaactgaacttttatcattttatatcaattttaagttcatttggtttaacacacatttcatttctaaatgcagttaattctgagaggtcatggggtgcacacattcagtcacacattagtatgaactagctcattgcttgccatttgacaccctgtgcacgtctctattacagcacgaaccacgttgtgttttcatcgtgccctggcagcaaaggagagggatgatggaagatcagagagatgcacagagaggccagtggaaaactattcatttccaaaatttgcctaagggttgccattccctcacaaatattaaacagaaaacatttggcacctacttctcctccctacagtaacacataaccaccaccccctcccccactgcctccccactcttcaccacccactctagagctcaggctcctcttagtaaaactacaattcttttacataagttgtcatgttcttgtgggatggcttggaaacctaaccatctgtaatgtggttcctatagaaaattccctaatatcaaatatttaatttaaaaaaaaaaagattaacttttgtaacacaattagtttgtaaggtgatggctgattctcctttaagcttattaaattccatgacacagtcatcatacttacctaattagtctaactttatactcacttttcaactaaaatgtttaagtcttttttatttcaaagattattgcaaactcaagtctctcatcacatctttaaacaaatgatttttatttactcctaaatgcagaattttattttgtcttcctaacaccttatcctgtagaatatggacttttattcctgctagtcaaaaattggtttgggagaacccaacacattaacaccccctcccatttccctgtttatccattaatttgtccagtatgaattctagaattccctattaagtcattaaacaggtgaaggccagacataaaacctaattttgatactgttacaaatctctttccagatatgtaatgatcaattaataaacactttagacatgattttcaatattattaaacactgttgtgtgaaataatctacctttttcatttcgtcaaaaatatagatatatcatgaagaggcttttcccaatgttttaatgaaatagaaacaccctttctacaccttcctgtttaagagctcaaaaaatatatatttatagtttggcatgacttgttcgtgaagaattcatgctgactgctagtaattactgccctttatttacaaattaggtttttagttttcctacagattggcacctagatgtccagtctaattaaagagatcatctttttacctatgttgaaaataagaatatttgctcttctctatgtattagttcatggtgctataacaaatatatcatagactgggtggcttaaacgacaaacatttacttctcacagttctggaggctgggaagtcctagttcaaggtactggcccatctggtgtctggtgagggccagctttctggtctgcagatggctgccttctctctgtatcttcgcatggcagatagcagaacacatcatgtctcttcttataaggacactaatcctattgatgaggactatacactcatggcctaattagctcccaaaggctccaccattctaatatcatcaccctgggagttaggatttcaacacatggatttgcagtggcaggtggggaagatacaaacattcactccagagcactctgctttctggcaggtctaccatttctcagggattcccaagaaagtttctgttatcacatctaaagatcattttagggttcagggatatactccttttggatgtatgtacttcaactaatttaaagagactaggctatcttctttactttcatcatctagagtttcaattattgtttaattaattaaacattttattaggtaatacaaggtttaataatgtatatagtgaaaccaagtctctctctctctcatccctgtcttcctaccacctaatttccctcccagaggcaactactttgggcacttactcttatagttccagagatatcatacataataccagaacatatggatttatatatttaatacgaattataacatttttgtttttctactcaattcaattcccttaatctttgttccacccttgccaatttgacatcatagtttagatgtatcataagtcatctattaatcccttatcatgtgactaatgtagaggatctattccttcctgtttttgtttttcttaccttcagcatgtcctgccagacctagcaaatgagaagtgctttagccttcccaactttacttttcctagtttctgccattctcttttatttgccttcagtcaggtgtccctgtattaagctattcttgtattgctataagaaatacctgagattgggtaatttataaagaaaagatatttaattggctcatggttctgcaggctatacagaaagcatggtgctggcatctgctcagcttctagggaggcctcagggagcttttactcatggcagaaggcaaggtggggagcaagcatctcacatggtgagaacaggagcaagagagaaagagagagaggtgccacacacttttaaacagccagatctctcaagaactcactcactatcatgaggacaacaccaagaggctggtgctaagccatcatgagaaatccgcccccaaagtccaatcactccacaccagaccccacctccaacactgggaatcacaattctacatgaaacttgggtggggacaaatatccaaactacatatgtccctcttctcatctttaattcatattctttcaaatttgtacccctacacagatacattggagtttggggttgtttatgttgttgttcaacaactatttatggaggacttaaacacatcagccacaatcttaggttccagtgaaagaaaatgtagtaaagcccaggccctaccaactatgcatcttctttcttcatgtttaatttatcacattccttttatgtcatatatagtcccttggaatcatatttcgtgttaatctgaaattgttgaaatttacttctcttaaagtctaggaggcatgtctaacattatcttatttgggattatcacccaaataaatggccactttctctataaccctgggcaaaagcttccccaccccctatcctcatgctttggaagtgtccatggggccaagatgatgcacccacccagagcccacatctattctatcctatcctacccagggtagccagtgtctcaactccctgctcaacgagtgcaaacccacttccagtgcctatgttggcctcttcgtggaatccatccttccaagactgaaccattcaatgtgcccaaccctatacctgagaggtagccaaaaggcagctgtttgccaatgagtgcagattgagtttgggtgtacaggctgggctgtcaacttgcaggcactcaaggcccctcaagtgcaagacagccagaagtgggaagagaagagaacaggccatgtgtcagggacacagaggtgagctccacctccaccacctccttctaaaaggaacccaaggattctaaaaccaatcttgccttctgggttatttgaaggtatatttctcaaagtagaaagattggcgagtagagcctactttagcagcctattacatagaattgtaacttatacacataggcatatggtgtgcaggcctccgtctgtaccctcacacttcccaatacaaacgttaaagataggcctgcccagactttctagcactccatatcaccaagtggtcagatttgcttctttcattgtttcctcaatatgccaagatatataattgccaaagagttaaggtgaaaagtcatgttattccacttttttttttttttggaggcagggtcactctgttgcccaagctggagtgccagtggcgtgatcacagctcaccactgcaacctccacctcccaggcccaagcaatcctcccactcagcctctcaagtagctgggaccacaggcgcgcaccaccacacctggctgttattccacttctaagagaaggtttcttaaaatttttagaatgtgtcatctgttactgtaatagttttttaaatctggaccagtaaagttactgaagtattaagctgtgtgacaatatctcttctcttacttctctttcctccatccaaatgctctctgttattattctttccttaagcttctgatttccatgcaagagtgtgcattcactatatgtgtatttctctacctcttttattaaaattattttgtgaacattcaaaattccattcatgagtaaataattaaaggttaaatagtcgaaaacacagaaataaaaaacattcatgatttattagtatatctgtgattatatttaatttgtgttctcccaggtaactattcttatttattatcgaccttctcccatgttttctcctgataagtactatacatcatctctattaacatggttctttctatgccctgattattgtcataacactaacacatacacacaggtgtgcacattcatatatgtttgatggttttatctggaaataagtgtctcttcctcaagtttaaactattctgatcatgtcaacaagtcttccaccaaaagtatctttgggcttcatggattcacagtggatctcatttagtgaaactctatttagttaaatataaaagagaaatatttgtattaatagtaggtgccaatccccaccatcatcacaaatgttaacctttgcctaatacctgtctcccaaaatatcagaagaaaggatcagcaactagtgaaagactgtcaagtactgaaataatgttataaaagagtattttaaaaattttcattaagaatttatcttgaggtcgcgtgcggtggctcatgcctgtaatcccagcactttgggaggcagaggccagccttccactacaatctcctgaggtcaggagttcaggaccagcctggccaacatggtgaaaccccatctctactaaaaatacaaaaattagacaggcatggtggcatgtgcctgtaatcccagctactcaggaggctgagacaggagaattgctggaacctaggaggcagaggctgcagtgagccaagattagaagatcgtgaaacagagcgagactccgtctcaaaaaaaaaaaaaaaaaaaatttatcttgaatgcataactgaactttataagcctcgctctcccccatcaccatgcctcagaaaaattagtataatatagtcaggaataatgtgaaggattgaaaccagatgttaactgaaaaaaaaaatctaaatcatcacaagaagatttaagtaaaggaaaaggaggcaagggaagtttgccatacaatattatcatagctgattttatacaattgagtcttggctagagtgaaataaaatggaaagaagacaactgtaatataaaacttccactacaatttctatacacactggttttccaagccccacctccatgtttccagtgcaataatttgctggtatgtttggcctaccaagaaagaaatacatacaccttctactctcttggtaaacaaaaggatctgaggtttgtcagatcaataaaatcaagaaactgcctgatatcgtaagtgatgaaggaatagttgggtctcattcttttcaaatgctcttcctggactttacaaatatttttgatgtgtttacatagagggcaataatctatataaactctcccacctagctttttggtaggctataagagcaaaatgatgtgagatcagacgtatccctagactatagggcatcattcatttattcattctttcaacttatatttactgactatctactctgtgccaatcacgaggagagtgtgaccataaacaataaagataataaatagtaaatgatttcgtatattagaaaataacatatgccattttaaaaaagaaaaagcagaatagagtaggcagggctgggtgatagggaagttcagagcagatttcagtattaaataaggtcaagactagcctcattgagaaggggacatctgagcaagactcgaagaggcaagaaaattagccaagcagacagccgggggaagagcactgcaggcagaagtaacatcacaacagaagcctaaggcagaaaagcagtggcagaacagcaaggaggccagtgtaagcagggcagagtgagctacaaagagcatagtaagagagaaagtcagaaaggtatggaggctgcagatcataagaactattgcagatgtttgagcactaaaacatcaactgttttatttagaggaatcactctggtgaatagaacgaagtacgaagggcaaaagaaaaaatagggacagccattgggagttcccatagtaacctagatgagataaaataatggcttagaactggttggtggtagcagaagtggacacagggttcagattgtagatatagtttgacaattgagacaacaggaattcatgaaagattaaacataggctagagagaactcaagatatctttaagtttttcgatctggagcaactggaaggatagagttgccattaactgaggtgggaatggctgcaagaggagcaggaagaagaagagtccagctggggacatgataaatttgaggtgcatattaacatcaaagtgaagatgtaaagtaggcagttagatatacaagagcagggtttgaaagagaaatctgaaatgaaaatataacttttggagttgtcagcataaaggtagatacaatgagactaccaaggaagcatgtagactagaaagaggtaggttgaagtccactattgcaagtgaatggaaatacaggcagtgatattcagagtatgactgtagaattgagatttgccttcaggtgaattaaaaaaatatgccccttctggacagatggattagaaaactgaccaggcacggtggctcacacctgtaattccagcactttgagaggccaaggcaggtggatcacctgaggtcaggagttcgagaccagcctggccaacatagtgaaatcctgtctctaataaaaatttaaaatattagccgggaattgtggtgggcgcctgtaatcccagctactcgggaggctgaggcaggagaatcacttgaacctgggaggcggaggttgcagtgagctgagatcacgccattgcactccagcctgggcaacaacagtgaaattccatctcaaaaaaaaaaaaaaaaaaaaaagacaagacaagaaaaaaaagaaaactgtgccactctctgagtagacacagccctgcaagtgttagcagaaaggcccacagtttgcccagcagagggagggctagatttcatctccactcagacccttagcagggtaatatgcagcagcccatgtgagacatcctttcgcttcaccctgcaacccccaccgtctgctaaagagttcttaaattctcttacctctcaccactattgggcctcagtgattatcagcatcagctttaaagttggactgcctgggtgagaatccaggctctgttccctgctcgctggtgactttagataaattactgatctttcctgaacatcagtttcctaatccataaaatgagaataataagagtacctacctcaaaaggatcttaaagattacctaagaaaatctatataaaatccattaacttagccaatatctctgacacctggcaggggctcaacaaacattagttgatatcattatccccttttaagtgaaagaacagaatctacttgtctacattcagattaaacctctccctcatctatagacctcataattattattcaagagtgctttcattgattgttttcataacaaaagactttaaaacaaagcttccctccggtggcctcattttattggatttcttgacttcaaaatcaataaggcatatttcctacatgtgcactaattagaaatgcaacatgcctaaagtactgtcttaaaaaaaacaaacaaacacattcctaatgcacaacagcctcctaaaggatcttgagccctttgaaatcaattccagagtggtacataaaaggtatgccccagggttagggctacaactgttagatgcactaagtgtggggaactccaagagtctgtactttttatttccttagcatccaaaatctctgaatttcaacagaacaaaacaatattacattttagaacaaaaggtaaatatcattagcatgttgtaattcaaactttataagcttgagtatttgaagttctctttattaaacctttagatagccatcttattgatgtttttgaaaaatgatcaaattgagcctcccccaaaaatgatgagttttatgaattctttatgaaaagattcaaacaaaattaattaaattaaaaaatgtgtttactctagccagagcaaccaaaattaaacatgtttcctcacacatacaaccaaaatgaaagcagcaaaaaaggtaaaaaaaaaaattactttaaccaatatgaaatatgaaaacaaaggaaaacaacagattctacttatatttaggtcttacaatgtccttctgatcatgaatagctggtcaaatctaatctccctcttaaaaaaagcaaaaagtcataattcaatttctgacttacctgaaaagtaatattgtacatgagaattccacaagatgactttatgaccctgacaacataccatttagttattttataacatgtcagttcatactaaaagctcaccacaatggcacacattttcaaaattgcagctacagagaaagaacagaaatgccccatggtcagttactctatgtagcaatgccttctacttaaggacattttgtaccatataaaaagtatgccaaaatggagacccatcttatataagcccagcatgaaggttacctacatattttttaaaagccatagaactaaattagtcaaattgaagtcaaagaagaagctaatctaatatatgagacaacagaaaagctttcactgaatcaccagaacaagaataaccttcagctacaaggcatcaactttaagcaaccacggcagaagtaatgtgcccttcacatacactttgaaagtgacagaggcttctgttgctgcaagtccagtgagcctatgggtccatcccattccataatattgtaaaacagctcaactgtatatgaattctcgtaaggtctgatatttttaaaaagcagagaacaaaaagagaatggcaaaggtagtagaattctcatcaacctcaatgtgaagccaaaaaattcccatttcttctttgttctctgttcagctagaaataaataaaagcctgcttatcagaataaataaaatgaaaccaaagtccttgaaaaacactatattcatttttctgtaaatcaataaatacacttaggaaaacaaatagtatgtaactggggaatttcagcttcttctgtgtctcctagttttccattctgtcataatccttgaagagaattttaaaaagtctctgctagaatctttaaatctaaccatccaagttcattatttatcaatattttcttaaagtttctccaggaacactagctaaatacctattaaccctacttaactgtttcttattacacatgttaaatatcctctctataggaaatagatgacttttctcccctggcttcaaaacaccaccctcctgcttctccccaacaatttagaattcaagaaacaaatggaagcaagcaacaaaacattagtaacattagaagtatcccatacacatggactgagaacacatttggggacatggtgggcagactagcaatttgctgtggaattacacagcaaaaaaagaaaagatggaaaagccacaaacactcatcttcactcatctttcatagcaagagattaatagatactatttgaggttgaatgcaatttctcattcatggaaaaatatgtaaacttaaccatgtaaaaagcctcccaacctcattcataataagagaaatgcgaattaagtccgggcgcagtggctcatgactgtaatcccaacactttgggaggccgaggcggtggatcatgaggtcaggagatcgagaccatcctggctaacacagtgaaaccccatctctactaaaaatacaaaatattagccaggcatggtggtgggtgcctgtagtcccagctattcgagaggctgagacaggagaatggcttgaacccgggaggcagagcttgcagtgagccaagatcgcgccactgcactccagcctgggcgacagagcaagactccgtctcaaaaaaaaaaaaaaagagaaatgcaaattaaaatacattgagatattctttctcacctttcagattggcaaataccaaaatttttataacaaactgttagtaaggctgcagagaaacaaatactcttataccttgcttgtggatatttaaaacattatccctatggagggcaaatatgcaatacatgtatatgtatatgtatgtatttaaactttgacccagcaattcagtttttaggactctaccacaaatataaaaataaaaagtgatgtattcccaaggcaattaattgcagcaattttactaaaacaaaaaaaaaagagagagagagaaaaggaaggaagaaagagaaaaaggagggagggagggagggaagaaagaaggaaggaaggaagggaagaaagtcaggaagttaggcagggaggaagggaggcagggagggaatgttggccctttcttcacatcacatacaaaaacttacttgaaatggatcacagagctaaaggtaggacctaaagctattaaacttctagaagaaaacataggaaaaaaatcattgtaaccttggcaaagtcttcttagatgcaacaccaaaagcatgatccataaacgaaaaagttgataaactggacttcatgaaaattcaaacttcgtgaaaatacaaaccatagacggggacaaagtattttgaaaatctacatatgacaaaggtcttgtatccaggaaataaaaagaacccttagaactcaataattaaatgaaaaacaactcaactctttaaatgggcaaaaaaaaaattgaaaagacatcttaccaaagaaaatatatacatggcaaataagcacatgaaaaatgttcaacatcattagtcactagagaaatgcaaattaaagccaaaatatgtactcctccacacatgctagaatggctaaaatttgaaagattataaatactggagctagcaaagatgagaaacaactggaaatctcacacattgctagcaaaaacgtaaactggtacagccactttagagaaaagcttggaagtgtcttataaagttaaacatatacccactctatagctcagcaattccactccttaggtatttagccaagagaaataaacacttatgtccatatagatacctgtatgcaaacattcatggtggccttactcataagacagtcatccccccaatccttgggggatatgttccaagacccccagtggatacttgaaacctgggatagtaccaaaccctatatatactatgctttttcctattcaacacacatataataaagtttataaattaggcacagtaagagattaacaacaataacataataaaatagaatgattttagcaatatattgcaataaaagttatgtgaatgtgctcactcattctctctcgcaaaatatcttattttgtgtcatatttttgaaccatgggtagctgaaactgctaaaagtgaaaccatggataagaggggactactgtagtcagaaactagaaacaactcaaattttcatctacaagtgaatggataaacaatctgtggcacaagaataccatcacatgttatgcaagaagaaagaatgaaccaagtatacatgcaatgacatgaacgaatatcaaaagcgttttgctgagtgagaatcagacataaataagtacacactatatgattccatttatataacatttttgaaaggacaaaaatacagggacaaaaaacagattggtagttgccagatgccaacagttgatgtaatcagttgactgcagaagggcacaaagaaactttttagcatgttggggatattctatttgattgtggcggtgatggttctataactgtatatggttgtcagaactcatcaaactgtaaactttaaaggagtgaatttaatatggtatatataagttatttctcggtaaatttgacttttaaaaacatcttttgtgttcatctcttatcccagtggcacagaaatatttctacattatttcattcactatataattacaagtttccactgatatcctttggctccaggagctcttccttaagttctctgaattaatactttcaaaagttgattcactttttcgaagtgtcttggcccttcttgtacatctgtcaatttacagtatttggtgcctaaaccctacctaacttcttaatagtattcattcccaggcttcacacctgtgtgttcaggttattctcaatatcatcctgtgcatctgatcagttatgtgttatatatttgatttataatttttctggcaagaactctaagtcaacctatctatgtgtttacaaaactacaaaaacaagagctttcagtatttgtttttgtactgctttaaaaaaaaatttctttttatttttctttgtgtgtgtgtgtgtgtgttaaagctagctgaggttttattttggaccaaaaaaaaaagcaattgaattgttttgtagctggaggcatgggcaagtgcggtccccagtcagtaaactctcccgtgggtgggctgaggggctagggctgagcctcaggtgggtctcctcttccctgtgctcctctgcacaacggcctccctcccaggatctggggcagccgcaggaggggcaggctgggaggggctgccgcagctgttgacttgggcaggacgtcagaggactcggacaccagcttcccatcgcgggtctcggtcttcttcacaaccacagccctggtgaatcatttcttattgaccttacttttaacaacgaataaaaaagagccaaatgactgtccctggctcatcatgttaatatcagaagacaacactgaaaatccttcgcaaattttaactactaccctcttgtcttttttcaattctgctctctgacagcagcgagtttctaagctagttcacttagacaagcccagtttagtgagtacaaggcccagagtccagaatcttcaacatagtaggtgtcctgcgagtatgtgaagatgaaagtacattataaagtcctgtctctggtttccttctttctacccaacaactttttttacaagttagatcaatccagttaattttgaccttactgaagttgaaattcaagttaaatttactgctagattaaaagtgtgaaaagaaggaaagtagctaatcccatttacaacaatttattttttaaaattgtaggactagtattcatacatttatacaaaattgctaaatatattttattttaaacattgtcttgatcatgtctgttctattatgtagatattttatcttatttagatcactctggtgtttccaaaaaactaagcttctttaatctctcttctgaactaaccaaatttttttctgaacatttggggccacatttactttcacataagttagtgtgtgggttaaaagggcagcatttcttcactatttttcaccaaaacacgagtgacatttaaagcatatttaatatttataatctaatatactctcctcattccagactgccaccaaggtaagagaaggcaactggtttgtatgaaactccaccataagatttctgaaaccctatattttctctctcatctatccataatacaccagagttatcattgagaattgctgcatttattttattgttttttttcttactcctggctctgttttatatcccacacttgttttctttcttctttcactccacatttaatttatcctatcttgaatttcatgtagccttataagtcaccttaaatcctttctagaacaagacaaggaataaataaagagtcattctaggtatctgaaaaagcaatcttttctcatttaccttagataaagccttacaactttaacttcttgctgcctcttagctatgctctaccgtattgaatacacaagtatcaaaaatcatgagtttctccttttttgctttaccaattctctgtttaaaaatatttaagtctgcgcacaaaaactacagggaaaaatccatgcacaatttaagtttaaaagcccataacttttaattaaaagcaattaaattatttgcacaaataacctactcgctgtacaatttttgtgtctaaagtatgtaaagtttctagtgccttgcatacagttactcaatcattatagtaatagctcagttacagagtaggagtttttaaatgagctgatgtaagactactatagcttgggtattggcacatgagaatctgttttagtgctatttttaaaaccactaataaacagcagactcgagcctctgctcaattgaatctgcctgagttgtgaaagaaaaaatgtgtaagagaaccacatttttatctaaatctgaaatgcctgctaatatactcggaaaagtagacatttaaaattggagctttcataaaatagtctagagtttagtgttactaaaacgaaaattagttataaaagtaaaaattgcacaacataatagtttctattcatcccattttatagaaataatgtcctttcatttcccccaaagttatctaaccgagcaacagataatctataattactaggatttgccttatagcaaagtttgatttttaaaagtttgacactccactcacctactgcaggacagagtattgcccatatacagatactaaaccaattgtctaagcaatttcttgtatttagaaattcagtgccactatcatggctcacaatttggcttatgatgcatct
